United States Patent 12,790,634 (MOST PROBABLE NUMBER ANALYSIS OF HETEROGENOUS POPULATIONS) - sequence listing, part 6

SEQ ID NO: 4 - DNA, 7383262 bp, unidentified (residues 1-1,845,816 of 7,383,262)
  source 1..7383262: mol_type = genomic DNA; note = Hungatella effluvii
cgttaaaaattttaatggctgttgtgattggagcgctgcttctggcagggctgtatgcactgtttggtgatacagtgctgccaacattaacacggcgtattactgaaatgtttaactatgctggatagaaaggcagttcaaacaattgtatttttgctgttgcttttgctggcatctgtcacggacttaaagaagagaatcgtgccggatctgttatgtatgctaattgcattaaccgccgctatttcttttcgtccagaacagttatgggggattttcagcgcactcccatttcttcttgcagcagttttttgcggaggaatggggggcggtgatatcaaactgatggcagccgcaggacttgtcctgggacttccagcagggatttttgcaactattttgggattattactggtacttgcttattctgtgtttttgaaaatatgtaagaaaacccaggttatcgcagtgccgttagtaccctttttatcggctgggtgtgcagcggggtatttgattggataggaggatggaatgaaaagaaaagcattttattgtatttgtgtagcggctccaattacctttgtgggtgctgtcctggcattttacagatgccggaggaaaaagagatacttagtgaggtaatcacggcggcaggtattccctgccgcatttaaaacgataattttgatttgattgaaaggaatggataataagtatgaaaatattaaaaagccgtaccgtgcttggagtaatatgcattgtggtatcactgctcatttgcttcggagttacccctttatttaataaagaggtcagtaaaaaggtagaaatcgtgcgggtggtaaaggatataaaaatcggggataaaatcactggcgatatggtcaggactgttgaggtgggaagtttaaatctgccgtctgaagtcatgaaaaataaagaaaatgtcattgggaaatatgcatctgcagatatggctccaggcgattatatcattaatagcaaggtcgcagacgaaccggctgcggagaatgcctacttatataatttatcaggagagaaacaggcaatatccgtgtcggtcaaatcttttgcaacggggttatccggaaaactcaaatctggtgatattgtatctgtgattgcaccggactaccagaagcaaggcgaaacagtgattcctcccgaactcaaatatgtcgaagttattgctgtaactgcaggcagtggctacgatgccaatacaggagaagaagacccggaggaaaaggaactgcccagtacggtgacactcttggcaacaccggaacagagcaggatactcgccatgatggagaaggacgggaacctgcacatatctcttgtatacaggggaacaaaagaaaatgcagcaaagtttattacagagcaggaacatgctttgcaggaactttacccgccggaaacggaggcggcggaagcggaaactggacagcccgaggaacagatagaagggagtgcagaataaatgctgaactttaaaatcaaaaagcgcgcaaatcagcctgagagcgaggaagtgcatgaggtgggaaaacatcaggcccagatactggctgtctggggtagccctggatgcggaaagactacggtttctgtgaagattgcaaaacacttagcggaaaagaagaaaaatgtaattcttgtgctgtccgatatgactttacccatgatgccttgtatctgtccaatggacgagttagaaaacatatggtcccttggcaatgtactggcagcgccacatgttacaaaagggcttatagaagaaaactgtattgtccacaaaaaaataaagtatctggcaatgcttggcatgttaagaggggaaaatgaatacagctatgccccctatgaagcggaacaggctttggaatttcttacagggctgcgggaattgtcctcatacattattattgactgtagcagttatatatctaacgatattttatcggcagtttctctaatggaagcagatgctgttctgcagatagtaaattgcgaccttaaatctatcagttacctggcaagtcagttaccgttacttcaggaaccaaaatggagaatagagaggcatttaaaaacgatcaacaacataaaggggcaggaagccattaaccatatggaacaggtgcttggaaaagtaagttttcagattccgtctgcatccgaagttacggaacaggggatggctgggaatttgttgattggtctggaggggaaaaaaagccgtggttttaaaaatgaaatagataagattgttaaggaggtatatggatgttaggggaaagaaagacgcgaggagtatttaatgagggaaaaaattcagagtggggttcgcggatgcaggaacttatgccaacacaggcagccccagtggagccggttgcaagagagccggtagaagtggtgagtaagagtgcagatgacctcttttttgcagccgtggaggggaaagattttgcaacggtgctacaggaggtacaggaacacattgccagccgttacagctcccttttgactgatggaaataatgatgatgtaaaaaggcagatgaagcgttacattactaaatatgttcaggaaaaccgggttgcagttcagggaatgtcaaatcaggaacttgttgacaacctatacacggaaatggcggagttttcttttctaacaaagtacatttttggagagggagtggaagaaatagacattaatagctggaaggatattgagatccagtacagcggtggtgggactgaaaagttggaagaacattttgacagcccttctcatgctattaatgtgatccgcaggatgctccatgtttcaggaactatccttgatgatgcaagtcctgtggtgactggaacactggctaaaaatatccgtatagcggtgttaaaaactccagttgtagatgaagaggtaggtcttgccgcttcaatccgaatcgtaaatccccagagtatgaaaaaggaggattttatttctggtggaactgccacgggagagatgttagactttttgagtgaatgtattcggtatggaatttcggtgtgtgttgcaggtgctacaagttccggaaaaacaacggtggccggctggttgcttactacaatccctgaccggaaaagaatttttactattgaaaatggtagccgtgaacttgatctaataagggaggaaagtggaaaagtgttaaattccgttgtccacactcttacaagagacagtgagaatgaccggcagcgaattgaccagattgcccttttggatattgcgcttcgatttaatcctgatattctggtggtcggagaaatgagaggggcggaagcaaacgccgcccaggaagctgcaagaactggtgtggcggtggttacaaccatccattccaattcgtgtgaggctacataccgccgtatggtgtccttgtgtaagcgtgccgtggatatgtcggacgagacattgatgggatatgtgaccgaagcataccctatcatagtcttttgtaagcagttggaaaaccggcagagggtaatcatggagattatggaatgcgagataaagcctgacggtacacggagatatcgtccactgtatcagtacgagatcatggagaaccagttggaaggagattattttgtggttaatgggaaacacagggtaatgaattccatttcggatgggctttataagcgtttgctggagaatgggatgccaatggagacacttaaccggttccgttcaaagggagagggaggagaggaatcttgacaagtatacagcttcttgcatgccttggtatgatagtgggtggatttcttcttttggggattcgaccaatagaatttacagatggactgttcggctttctggcaaaagaacctgagaatattcggaatgaaatccatacagtaacaaaaaggaaaaaagcaagatttctgaaaaaggcaatcattgaggcacagcaggtacttaaaatgacgggtagggaaaagcaattttcggttatttgtgctgccgccctggtgttgtttgctgtgggggcctcggttgccatcatgattggaaatttttttctggctccggtgatggctgttggatttatgttcttccctttttggtatgtaattctgtcagccagtaattacaaaaaaaatgtagccgcagagctggagacagcattaagcgttattacgacgggctatctgcggacggaggacattctaactgcgatagaggaaaatattcagtatttgaatccgccagtccagagggtattccaggattttattgtgcggatcaacttagtaaatccggatgttcatgaagcactaaaggagttgagggagaaaattgataatgatgtattccgcgaatggtgcgatgccctgtgtgattgtcagtatgatcggagtttgaagacaacattgacaccaatcgtaacaaaattaagcgatatccgtatcgtcaatgctgaactggaatatttgattgtggagccgaggaaagaatttatcacgatggcaatctttgtgattggtaatatcccgctgctttattttctcaacaagagctggtatgacactttgatgcacacaccaatgggacaggtgatacttgccattactgcggcaatcatctttgtctctactgcggtcgttgtcaggctgacaaaaccgatagaatacaggaggtagggagatgtcagtgttattactgttattatttggaggatttctctttctgggaatgttcttcctggcagcggatttgttaaaaatgccatatatgaagacagaaaaggcattactggacaggggaagaaatagtaaaaaagggtcggcggcgttagatacgtttttactgcaaggagccatgagattgtctcatgtaatccgaatggacgaatatcggaaaagccgaatgaaaaatgtgctgaaagcaacagggattaatatgacaccggaagtatatcaggcgtatgcacttacaaaagctggtttactgatggctggcattattccgtgtttgtttctttttccgctcctaacacctgttattgtgtttcttgctgtcatggtttactttaaggaaattcagcgcgcagacgagatgttaaagacgaaaagaaagtcaattgaagacgaactgccacgttttgttgctaatcttgaacaggagctgcagaataaccgtgatgtgctttcaatggtagagaattttagaaaaaatgccggtgcggaatttggggaggagctaggtgtacttgtggcagacatgagatcctccagttatgaggcggcacttactcgatttgaagcacggttaaactctccaatgttgtctgatgttgtcagaggactgattggggttttgcgtggagataacagcgtggtatatttccagatgcttgctcatgattttaaacagcttgaattacagaaattaaaaagtgaggcccagaaaataccgcctaaaatcagggttttttcgtttctcatgcttatgtgcttcttattgacttaccttgcgattatcgtgtttgaaatcattaagtcattaggaggtatgttctagctccaaatgaaaggaggtcaaggaacttgaaaaaaatattaaaaactaatcgtggagagggatatatagacatatgcgtactggtattgtgtgccatgctggtgattgcattggcggtcagcgtatttccggtttttttggctaagaatcagttagatacatttgctgtggaattgtgccgtgaggctgaaatgagtggcagagtcggaactgagaccactaggcgggaacaggtattacgagaaaggaccggactaaatcctaaagttgagtggtcaaaaaagggtaatatccaactaaatcaggagattactgtaaaattgacgttgcagcgggaccttgggttatttgggaattttggttcctttccaattaccttaagggctagtgctacaggaaagagtgaggtatatcataaatgaagcgcctgatttgctgtttaaaagataggcgtggttcctctttcccatttgtgattgcggttacattggtattgatgttaataatgtgcggatttttggagttttatcggctaaagatcatagccaatggcgtaagggacgcggcacaggaggctatcatgataactgtaaatgataattatgcaaacgtttatcacggtgtcagggaaggatacagtggaggatatcagcccaataatggaggttttaagtatagtgtagataaaggaaatgtgctgtcaaaaatggataaaatccttggaacaaaagttgaatccgggcggcatgtaaaatatacaggtggggttctggaatatagcatatcggatttaagtgttactgcacgtaatgcgccgcttgcacctggaacaccggaaaatgaacagagatttgaaattgatgcaatcgtaacattaaaagtaccggtccagtttgcgggaaaacgtctacctgaaatgaaaatcaggctaaaagtgcaggctggatatatagaagtgttttagaattcaatagacagaattggaaaaatgtagtatgtttgatgcgacagaatgtgaaccaggaaggagaactatatgaatgataaagtgaaaaaaggtatgattattgcgggttgcgtggtgtgttgtgttattcttgcagtgatgattgcaagtaatttcagaaagccagcaaaaacaaaggataaattagcagagagccagtctacagaaatagaagtgaaaccggaaatcaaaaagtccgaattagacaagaagtcaaaagagactgaaagtaaagaagaggaatcgaagaaagaaccggagactacggaggagcagaaagaatcagaggaggaaaaagagggaaataaggacaacgggcagcctgtacagaatattcagcccagagtgactaaaccggaagaaccagatccagaagtattaaaaaatcctaatcagaaaccagatggggagagcgtgcagggcacgccggttccggaaaaccatgatgaagtaaaacagccggagacagacacggttcctggagccgcaccagaaggtgagtcacaggaaggaaaaatatatgccccaggctttggatggattgatgacattggggaaggggaaggcattgaagacagtaacatttatgaaaacggtaataaaattgggataatggattaattatcaataggttggttaaatagatgcatgacagaaaggctatgaattgtagcgccctcctgctaagcatagagagaaatcaaagatataaattttatcgttcggcacagctatttatggctgtgctttttcattggaaaggagaacatttgggaatttgaaaagcagaataagttggctgacaaggattgtactgttcagcctgtgttttttgatcatgtcggttccagcgtatgcggcaggggaaggtaatgtggacggcggaggcggcagcatgggacaaggttcttcgcaaaatttttggtccccaggtgatgaaggggtacgtgtatcggtgataagtacaagtgaccataaagtagtaggcacgcctattgaccttaccaataaaagcccatctgatattaggcttcattttggaaaggtgagcaagatgtcttatacatcaggtcatggaattggtatatccggttcaagataccagtacataagaccagcacagagacttcctataattataagttcacaaagtctgggaccatcaagtattgcggaaataaagcggtactttacggacgagcagacgatacgtgggatagcaggttatatgggaatagattttgatatacttatcagcggcgagtacagaattatgatagagccgattgcgtatgtgacattgcagggagtaagagttgctatgacagcaacggaagcggctttatatgatgaggttgcaggcggggtggtatattcctggttacgttcagttacctttcaaaatctgccccttgcaatgtttctcgaaaaatctgatttaggatatcctgcgtggaacggtccaactaccggattgcgttcacatcaggaaatcaaaacttcgttgggacttggaatcatacgttttaatggggagttgccagaaccatcaccggaggttacgacttttgattatgaataccgcactaacacggaggttatcaccagtatccgcgtgagtggcggtcaaagtgatccggaccataaggtatctgtgacatttaaaatacaagggagaaattataaggtggacagcgtatattatcccgagggaggaagtcagcttgcctgggttcggtggacaacaccatctacagagcagactatggaaattccagtaacagtaagaggtggtggccgtacagacaaagggactatacgggttaagatagtaaacctggacaagaatccaccgccgaatccagttgcagatgaccgtaatgacagttatgcgaggccggcagttccatcaaagagtcagcaaacgtccgctgattggagtatttggcgaccatactggtattcttactgggtatggcatagtggtgacgatgatgatgatggatactggtgtgatcatggctggtggaagttcaatattgatagatatcatgcaagtttgaacgcaacaatgcgcgtccagccagatgataaatcccctacggcccatggcaaaacattaaaaagcggatacggatttaacgaatatgtgaacagttctgtgagcacgaatcagtccagtgccgtgactggagcccaaaatgccgtgacgtattttccggagtttcaatacaagaaatactggcgtttattggagcggatgtcgggtgggtatcattccgaatttgagttcaaaaaaaatcaatacagtacatttaagcggaggacacatttcactccgatatggatgccagatggcaaatatacaccctatacatggttaatagatgcctggacaccagcaggaatgttatcactaaacctgaccgataatctgacaatcagcggtaatttgtggacggactggcatatcgcaccacagagactagattaaaaaataaagtaaaaataaataaacagttaccaaagagggagacgcagagatcttcctctttttgttattaggaaggaatgaagtggcatgtacgataaaaacaaaactttggataccctgaaaaatgaaatcttcttgtcaaaagacaacctgtatctagcggaggaagcgttaaattctgatcagataccctatgaaacggtaaagaagattatggaggttggaggatatagaaataaaataaatgctttgcgcaaagcgtatttgatgggtgtaaattttgacaaccttatcggtcttgtacatgattcagacggcccggaggaaatcaggtcaatagctggggcactggaacggaaactggaaatccagaaaattcagattgtggcagatggaaaacacgattacagacaaatggatttagtgttttatgggttttatactggcagaagcatacaggaaatggaactggcaacagataaccggtttgatgaagagcagattgaagaaatcctgtcgggttttcgctatgggcttgcctatgaacaggtggcattttatgcgaaagaagaatttgattgttaccagatgcggaccataaaaagggcgtttctgtacgataatctgacagtggaggaggcggcaatatttgctttacccagtaataacacaaagaaaatgcgccaggagattagaaagatagtagcacagcgcggtaaaacaaagaaatccaatctgtaatcgtgagaaaggataaacacatggagaaagaagcaatggaagatatcctgcgattggcagaggatgtaagcagccttgtgatggaccttggaccatttgggcttacggacgaagatgaagtaaaaaaaacaccgcaggaccggatacatgagacatatcaatggctgtccgaaccaaagggctgtaaagaagcgtccgagtattttaaggaattgcttgcaatactggataagacggacgcagagtatcaaagaatcgctgatatatgtgaaagaatccataaggtccaggaaataaagccatggaaagaaaaagtaactgttagaaacagtcccagctgtcgcagatgaccagggcctggatatgtccataatataggacagattaaggaaacagaatcccttcaagtagagaggtttcatagattcctctggtaaaaatctaaatagaaatgcaaaaaggagggataagaagttgtggccacgtaaaacgatagtctcttcgacgcttattggatttagagacgaagagcattgaacggattaaattagcaagtgaaatgtcaaagaggtactatgatgcccccataatctgtacttacagtgggggcaaggattctgacgtacttctggatttgtttatccggtcaggagttgaatttgaggcccacaattctcatacaacagtcgatgctcccgatacggtgtactatatcagggagaaatttcgaggtttaaaagaaaagggaatcccatgtattatccatatgccgccactgagcatgtggcagttgattgtcaaaaagaagatgccgcccaccaggatgcagcgttactgttgtgaaatcctaaaagagaacacaacaccggacagactggtatcaacaggtgtgcgctgggacgaaagcaccaaacggtccaaaaggggacagttagaagcggctgccccaaaagtcgagaataggattactctgatgaacgacaacgatgataagcggctggttattgagcggtgtgcaatccgtggcagggtagtgtccaacccaatcattgactggacacataaagacatctgggattatatccgttccaaccatatgccttataatccgctttatgatatgggttataaaagagttggctgtgtagggtgcccgatggctggaaaaaaccgctacaaagagtttgctgacttcccaaagtataaggcagcttatatccgggcgtttgataaaatgttagtggcaatccatgcggcggggaaacctactaagtggaagaacggagaggacgtgttccggtggtggatggaggataaaaatgtagagggacagttgtgcctcgcggattttatggacatgggaccagactaaaacaataaatcaacaacaggaggtttacgttccaaccggaactaatttatataaaaaagtgaatgaaagcagtaccgattgagttaaaggcggcaaatgaatatgtcgcgcagaatcataggcatcatagccctgtataccgggacaaattccgtgtcgcatgtactgagcatggcagaatatgtggcgtgatacagtgcggcaggccagtatccaggcatttagacgatggaaaaacgctggaagtaacgcgttgctgcacagacggtacagccaatgcctgtagcttcctatacgggcgggtagcccggattgcaaaagagatgggatatgagcggattatcacttatatccttatctctgaatccggtgcttccttaaaagcggcagggtgggaatgtgagaaagagattgcagggggcggctcctgggatacacctgccaggcgcagacatacaacagcaccgcaatgtaaaaagcaaagatggatgaaaaatttgtgtaaagaaggtgatgagagtcgagaatcggaattatagatgctgatttattggataagaacaggcaccgcatgccgaatctggcatgcatgaagatcagcggattccataagcagatgggggatcagatacatttgctgacggagtattcaggcttcaatgagtttgataaggtatatctgtcaaaggtctttacggctacgaggtatccgccggaagtcttaaagatggagaatgtagaatatggaggtactgggttttatttagaccaggctcccgagctgccctacgaaatagagcatgccatgccggattacagtctgtatgcggattggcttaaaggtaagggagaagaaggaaaaaagagtaagaagtataagtattatcgggattattctattgggtttttaacaaggggctgctttaggcaatgccctttttgtgtgaacaaaaataaaacggtatccgttcctgcaagcccagtgtacgaattttacaatccacagaaaaagaagatctgtctgctggatgataattttctggcatgtggggagtggagtgcattattgggacaactacgggaaaccggccgtccggtccagttccggcaaggactggatatcaggctgattaccaggcaaaaatccagggaactggcatcttgtagattggatggcgacttattatttgcctttgacaatatcaaggataaagaaacagtcatagaaaagatgaagatcataaacccaatattccaggaatcaaaaaggatcaagttctatgtattaactgggtttgatgcagatggaagatatgactggactttctggaaacaggatatcttacaggcatttgagcgtatccggattctaatgggggtgcgtgcgtatccatatatcatgcggtatgagaaatatcaggaatcaccttaccggggaatgtatgtaaacctgtccaggtggtgtaaccagccccagatgtataagcagatgagcttccgtgaattttgccacttgtcaaaagaagggagcgcctgcagaacgtatctggaggagtatgaaagagactttccggaaatcagcagttattttgacatgaaattttaaactctgattcaggaggtggtgctatgaagtttacagatgaagaattagagatagccagaagcgtggacctggtgtctattgctgaaaggcagggcttcacggtgaagcgggtaggcagttactatacattgaaagaacatgattctataaggattaaaaatcgtaggagctggctgcgtttttccgtacccgagggccaggacggtcacaacggggataacattgagtttctgagacaattttgctatatggattttcgtgaggcggttatctatttgttgaacgaggccggttatcggtatgaggataaatcatttaaagatgatacaagcaggaaaaaccacgagagaagaaaggaagagcaaaataaagaacaagaagggaaaggggagtttgtgcttcccgaaccaaacgacaattatcggaggttatatgcctatctgttaaaaacgcgctgcctgagcaaagaagtagttgactggttcgttaaaaaaaagctgatttatgaaacacgcagatatcataacgtggtttttattggcagggattcctttggtacagcacggtttgccagtatgaggggaacggtggataattatggaaacccgtttaaaggggacgtggagaacaacgataaaacctatggtttcaatgtaagaaacaagaaaaataaagaagtcaaggtatttgaggcagccattgacctgatgtcttatatggattataagcgtgatgggcagtcaaacaagttggcattagggtcaacctgggacggggcattggaccggttcctgctagaaaatccacagattaaacgaataagcctgtatcttgataatgataaggcaggccggaaagcagcggcacttatacgcaagaaatatatagagatgggatatcacgttaaagtccggttcccgccatatgggaaagattggaatgaatttcttgttgcagaaagaaaaaaggcagtgattcaatatttgaacaggaatagcaatctggaccggaaacaggcaatcggataatttcataaaagcaaggagatagtatggattattttaatttcaaagaagagtttctctatcagttcattgacctgatggagaaaagcaaaacgttaggagcgttgaacttggttatggaaggactaccaggtgaatcaatcacaatgactttcaaggataggtactgccctatggtcagcatagaggaactgtttttgagaagccagtatgaaatgctgccagtcaggatattggcttcggagacactgcaggaatttcagacggcggaaaccggaggtatccgattgaagatggatacggtcaagaatccattgtttgtagagttccatgcagtgaatgcaaacaaataccagatgaggctggaagaattggagctgccgtataccagactgggagatatgtgtatcttttatcggttccgtgtgaaagaggaaagtgaaaaacttgtatacaccatgcccgtagatgaagaggacttacagcggtggggaatgcatgtagatcaactgcatgcgtgcgtgtcagacaatgctttctcccagtatagtgtgcagattgaaccggttgcagccgttatacgggaaggcttggaggcaggctttacgcttgggagaggaaagattacaaatgaacgcgcaagtgcctggcggctgacaggtccgggaggcgcggcaggcatgctttataggaatattctggatgaatttgcagaaatggtcaacacggatctgtacctgcttccagtaacagcagaggaaaccgctatatatgccgccgaccagtatacacctgctgaccttcagatgcgtctcgaaagaaaaaaatccttaaagggatttgtaagccatccgttgtcagagtcggttttgtattatagtctcaagagtaaaaccctgacggtgcaccagtcttcattggtgaaaaaaaccctggtctaagagtcggtacgggagtctacagatgcaggaaatggtaaatagacgaagaggagaaccaaaatgcgcgaatatgatgaaaaccatgcatatgaggaagtccgggaggatttcattaaagaatataaggcacagctagaacgcagaggaaatggggagaagttggaaatagtggcggaaggtactccttttgaatcctttacatacaaagggaatggacctttattatgtaccagtatctctatggaactggtgtacagaaattgctatatttttgccattcgagagattgatgaggccgtatctactatcttggagattcaggatgaggcagaatggatatccccggagcggctggaacaactggaacatgtaatagtgtttccggtaaatctatcacattgcagggataagctggaagaaaatgatattgcatattttcccttcgaagatatggcgatcacttatcaattctgcattgaggacaatgagaggtcgtatcgcagggatgttacaagggaatggctgaataggcaggggataaatgcaaaggaactctttgaaaaagtaaggtataaagacctggagcaaatttggggcgaaattaaaaccatagagcaggtgggaaaaaaatcagaggattcacagcaggctgctttgtatggcgtcaatggctttggtgctgccctttatccaaaagtgatggagcaggtagtaaaaaaaatgggcagtgaagtgctgattgtacctgaagaaacctatacggcttatattcagacaccggatattatgagtgctgcaaaactgcaagaagaattacaggaggacaatcgtgtgaaactggtgactggcgataggcaccttgtactttctgggaagatatttaagtacgataccggcaggaaaaacctggtcccggcaatggaacataccattgaaaagcatagagtgaaatgaaaaccgctttaatcgggagaagcgcagacggccagaagggaaggagatagatgtattattatagtgagaacgaagcatatgacgaattacgagaggattttattgatgaatttcaagaccagctacaagaaagagacagaggggaggaactgaagctgatagctgaaggcacgccatttgaagccattatgctgaaaggtggaggggagttagtttgccccagtattccgatggaattggtgtatcttaactgctatgttgctgagaacaacgagttagacgaggcggtcacgcagattctgggtatatttgatggggatgagtggataccgcgcgaacaatttgagcagatagagcatgtacttatatatcctatgaatttggcagaatatgaggataaactggtggagggaaacattgcatatatgccatatcaggatatggcggtcactttccaattctgtattgaaagaggggagagatcgtactgcggagatgttacaaaagagcatttggaaaaatggggaatcggtgtggaggaactttttgagaaagtcagatacaaggatgcaaatgaaataggagtgggtatcgtaaatatgtacgattcacttacaaacagatatgaaaatgataaaacaatcctttttaggccggcggatggtgtgccattggaactgaagcaagtctacaatgtctatggtgtgaatggctttggtgcaatcttctatccgaaagttatggaactggtgtatgataaattaggggacgagatgctgattgttcccaatgatgcctttggtgcttatgtccatgcgcaaagtgttgggaatctgtcagacttatatgagagcctgaccagtgagaatataatgaaagaagaaacaggggaaatacgccataaactatctgagcgggtttttaaatacgatctggaaagcagaaacctgattcatgcagttcctccgaaaattgagaaacaaaaattgagataggtaggtgggttagtggattgatgaacttaataaactatgaccaatttaaggttgcttatctacaaaaaatagcagaacttttagaccagcatggttattccatcagaccggtcgtgataggggaagggttatcgctggaaaaggcaaccctggatttaggcgataaaatctgtcattgcatagaccttcaggaaatttattcggattattgcaaaaatgctagaccaatgttttctattgtgaaggatacattggattgtttccgggagtttggtacagtacaaagagaacaggtggaatgcatagaaagtgttttagcctgtgtaacaaactttgagaaaagcaaagaaatcctgcggggtaagggtataccatatttggcagtaggtgacatggcagtatatttcaggtttgattatgagctgcctttcggcggtacaatggaaagtattgtaacaaaagaccatctcctaaaatggaagttttcagccgaagaattattcaatattgttaggcaatgcgaggcacagaaaatcggtgcctgtgcttatgactgggtggaaagccttcaaccatatgattttggccatatacctgtgattgcaagagcagaagatatctacaatgcgccatatgagctgtatggattgaacggtgccggggcgatactttaccccgaagtgctgcgtcaatttgaagaggcttttcatgagcgggtcataatcgtaccgtattcagaacgaaaagcggccatattaccggaaagccgtatacaggatatgtgggtacaaagaaaaatccgggagtatacggaggatacggacgcgcggttatttttgtccaggcaggtttattcgtatacagaggggaagttttacaggctcaagggtggtatagaacaattacaggctgtcattgatcagaaattggagacaactatgaatcatgagaaaacactggtcggtaaaaagcaaagcagataaaatctcaaggaggacagacaaagatggaatatgaagaattcatccagttttttacccatgaagtcaactataatttaaaaatgctgggtgttccatggcgggctaagtatgagaacacaggcggcagagaagaagttttggtggtaatccatggtggagggcatgattttcctccgattaaagttcacgattattaccaggagtttttgcaggggatgccctggggagtcgctgcacggaaagcaacacaggatttctttgatgatgagagcacaaaatgtgcactgatggatatggggctttttcatgcagatatggtaattcccacttttatgaacacagaggaaaatgaggaactattgaaaaccgttccatattcaaggtttgaagatttagcagttatacttcaaattgcatatcagtccctgggcggtatcaatctcaaccttgtggtaacagacgatatcttacagggatgggggctgaggtatgatgaactttatcaaatggccctggataatccgaggaatgttgagtctgtacagatgatagagttgcacaagatgatagatattatatcacccgatgaaacagtagaggatttacctcccttctatgtggtaacgaatactggtcaacatttaggcgctgcaggtattctttacaaaaccagaatgtatgaacttgcagaaactatgggggatgatatcttattggttcctatgagcgttgaccattttttggcaatgccgcttttagaccaaaagggcatagattatatatctaatgcactacacagtagtaaagaggtaatcactggaagtataaagcccctgtctgggaatctataccactataattgtgaaaccgcacagtttcgtatgattactcccagccagttaaaagaaacgaaaaaacgaggcagatagggggagggtttgagaaacgatagatattcaatcatagagaaaagggaattttatgaaacctttgtatatgaattaaacaataatttacaaaagatgggattagggtggaaggtggtgctgcctgaccatatttcggatggctgtgtgatcagtttacagggcagcccagagaaaggctcagaaatatttccttttgtagcatataaccgtcatacacagttgggagaacccctgtggctggtagtcaggaattcgctagagtttttattgcgggatgaccggatcaccaaagccgcatttaaagagatgggggtgttatcgccaaatctagtagttccgacattgatgaacgcgaaaagaaatcaagaggtattggacaatttcccacataagctatatggagacggggaccttgccattgtattgaggattatttatcattcaacagattgtttgcttgaagatatgcaccttaatttaagagtgacaagtgaaatgctgaatgagtttggaatggattttgataccctttatcagtggtcgcttgataatccggaaaatcaaagggctgtttccgtggaaccgtttgggacagaaccggaaaagaaggatatctacattatgacaacagagagcttttactggggtgcttctgcttttttatacaaagaaaaagtacacgagctgtcagataaactgggtggcgatatgatactatttcctacaagtatcaatcaatgcgtggcattatcaaataaaaacagggacggaagaaaatggattcaggaaaccctctacgactctaaacaaaatggttttcagcagagggaaaaagatttatccgattatatttatgtttatagccggaaaacagatgagatccgtaaaacaagtcaaaggatgcggcagaagccaaaagtgaataaaaaccatagcaggtgacttttcagagcgattcagaaaagaacctgcttttttcatttaatcataaaggagataagaatatgaacctcaaattatataaacagttttcagatgcttaccagcaatgtattcgttccgcttttgaggattccgcaattcgcggggaagttagaacggtggctaggggtctcccgaccgagggaatcacaattttatttgagcaggaggggcggtactgccccgtcattccggtaagggaggcttttttgagagcggagatgtttgacacctgggaagaggaattggcagaccgggcgatggaagtgttctctgatgcggaagcggaagatctgcgtattgcagtaggccagttggaacagccggaatatgtggcagtatatgccgcaaaccatagaagtgacctggaagccctgaaaaagaatgatatgccttaccaggttatgggggacatggtgctctactatatgtttcacgcaccgctgggagacgggcgttattatcaggcagaagtaaccaataaacatctggcatcctggaaaatgagaaaaagtgattttcataattttgtactggaacattcgctggtatccatggagagcaaaatctatccgttgtgtgagaagattgaaaatgtgctggaaggtatttcgtgctgtctgaacaatggagaggcagaggatagccttggttatgtggtcacgggacctggaggagcggcaagtgtattatactgggataccttacaggaacttagccgcctgatgccggatagcttttatattttgccatattcagagagggaggcttatatcctgcctgatactatgggagcactggcaccagcattttccattgaagatgtccacaagaatgggaaccgtcaggttcgacacagcttggctgggtatgccatatcaagtcatggtttccactattcaccatcggagaacaagaacaaattgctgaccatacgcgaatggttgaagggtgtaaatgaatgacatatgaagaatataaacagggactgattacagaacttgggcgtcacattgatgaagagcatcagagattgatagtaatagcagaaggtacggacaatgaggaaatagcccttgaacttatgcagccgcctgtgtgtagccagtcattgtcaatccatagcttatatagacagtggaaagaaggcgaattaacggcccaggtaagcagtatctgcgattattttgaaaaaaagcgtgctattgaaacgattgagcagttagaaaatgttacgatttgggcggctaattttgaaaaggcagccgaaaagctggaagggaatgatataccatatctgcctgttggggatatggctgtatattttcagttctttgatgaagtctatgacgaggatgaacagtggcctctggattataaaagacctgtccaaaatgaacatttaaagcagtggggacttacggtacaggaattatttgataaagtcaaataattcgatatgaatgaacgctttcagacggttttggatacgagcagagctgttctggctcatacattaggggcattaagcggggcgcttccagacacaaaagactattacggggtgtacagcgagaatgggattgcaatcatgttctatcccgagggtttgagtgaaatctcaaggcgtttggatgatgacctgtatgttatgccgttatcaaatgataaaatccttgtctgtccaatatcaggacacagtttggaaactttgcaggaaatagtaaaaaagagcaatgagatggataaaagagcagaagtgttccctgtccaggtctctaatatggtgttccagtttgatgccgaaagccttgcaatccaaccggcggcacagatagagaaaaaaacgagacataaggcaagataagatgaaggcaaatctttgaaagggggtggttaagcccaatccaataaaaattcagcagtcatagaaatttaatttgtaccagtagctcgtaacttattcggaaactgattacattcaaacatttgaaaggaggtaagaggtaatcccgggtaaaatgtgtagctacaccctctaagaagggaattggattataaattaataaatttttgtgagtttgacaaatatgcagtaaaaagttattgcgccatacatggggttgacgagagtgccaaccttggggatattacgaaagttgatgagaaaaagctaccttatttcaactttatctgcggtggaagcccgtgtcaggatttctccctaagtgggaagctggccggttccgtctggaggtgcagagattgcgggcatgaggtaaacccgctgcaggtacattggagcaaacgggatttttgtgaaaaatgcggctcaaagaatctggataaaacaaggtcctctctccttgtagagtggcttcgggttatccgggaagtaaagccgatgtttggaatttatgagaatgtaaaaaatattgttcaggcaaggtttctaaacagcacattccgtctatttgagcaggaattgcaggaatatggatacaacacctattggaagatattgaacgcgaaaaattatgggattccgcaaaaccgggaacgggtatacctcgtcctgattaaaaaggaatgtgataatggaaaattcgtattcccagagccaatggaaaacgggaggcggctgatggatatccttgaagatgaggtagatgagaaatattatctgtcagatgataaagtgcagaaactgattacagacatgaaggagcggaaagcgcttctgtatatgcctggggaagaggaactgaaacagtgggaaaataaactgtataaagttggacaggttcaggggtatcttggcgatccccagactggcagggtatactctgcaatcggttccagccctactttgctggcaagcggtgccggaagaaataaaatagccgtggtcggaagtattggaaattcccaacagagtgttatactatcagggatgggaactgccaatacccagcttgcgagccacgaccagacaaagattttgcaagtgggggcaatccgtggaagatataatgaagagggaagagtcgaacagcacctggaactaaaggataagccttggtgcagctatgcgattacctccgtacagaaggataacatcattctggtgcggcaggacaccgtaaaaggctacgaggaatgtatggcagagggagttgtaaatatcgcctatccgaatgctgccggaaaacggggccgggtacagggacatgggaccatctgcccgacaatcactgcgcagggaaattccctgtgcaggctggaatcaatccttcgtatcaggcggcttacaccattagagtgcttcaggctgatgggttttgatgatgaagattaccagaaggtcctggaagcgggcatcagtaacagccaggcatataagcaggcaggaaattcgattgtagtgaatgtcttaaccagtatttttgaagctttatatagcgctatgccttacctgtttgaagatgtaaagataggaagctttttttccgggataggtgccttcgagaaagcactggaacgattttatgggaaccgtcaatgacagagatataaaatcttaatataaagaacatcaatgcagaatggattgggaaaaacagaactattttaaacagcaggtcaagggatgctatcaaatgcggcaacctagtatcaaaaacaaaagtggaattctgctatcaggtttaattgactgatagcagataaccttggaatgtgatatcacaaagcctttgatgatatcatactccatactgcctgctatcagatatatgaagctgatagcaggcagtatgtgatttgaggggaaactgctgtcagtttcccttttctgctatcagattttcgcgtaatatccgcggaattgatagcaaaaaattgtgaatgatatcagctttttgaggctgatatgggggtattaggggatctcccctaacaagatggattttgtacggcaaaatccgtatcttgcagaggactggcaaagccagtccggaccggccccttagattttcagaagtaaagagggcaaaaagaaaagggaaggagctggaactgtaatagaacctattgtgaaagagcagatattggtggtcagggatactggtgaaaccaatatgtttgacgtgactgcagttacgaaaattgcactaaaaatgggatttctcgaactggcggaatatttgcagaaccataaaagcgaatattgccattttattatatgggggaaaacttccgaacaagagcatcagaaaaaggaggacattcccaaacaggacagacagaaaaatagataatacagaatgtaaaggagacagagtattgaggtatgaaccagaggaatttgaacgattaaaagattacgtggacgaattcatgaagagaggaccattgggagacatttttaccccatttttctataagccgtatccttacaaccaaaccgaaaatgttctggatacgctccggtttgcggatgccaggaagctgcttattgattacttatataaggtcagccgtgcaaaaagcattgaggttacaaggcagacagaaggcttgatcggagaactatgggaatatggatatcctgacaaaaatagagagtcggactttttgaaaaatctggcctgggatatatgcagaatgacaaaatctgttgattactggcaatgggaagcgatgcgtttaccaggagaatcggagtcggacgtagtgagacgtacctatcaggagataaagaatccggagaagcggcgtgagttcatgcaattctggattgactatttggaacgtatgaggcccaaatatgaactggaaatacaggctgcggaagttttaacaagactaaacaaaggatttacgcacatggaaactccatttatggagagaattaaggtactcgtagaaaataaaaaatttttagattctcaaaagtatcatgatgccagtatttactatatcctaaaaaaagaacaggatggggccgtcagttacaagggagttgctgaatatgagcaggaaatggcagtctatttttctatttctaaggaagaagttactgaaatttatataggtgatacatcggttcatgaggatctgtttaaaccgatggaagaaggctataaaatagcggcgattacgatggatggccactttaatgtctgggacgaacttgacagggagggcctcgacgcgttgccccatagagagggatttgaggattaccttatttactgtaaagaaagaaatatcacagcggcgtctattacagcgtctatcggatggagtgtaggagatctgcttgatgaggtaaaattacagaagcaggattatatgaatcatgtgagccaggcagacagaaaaaggactcgatagtgaaaaaactgaaatggcaggtaaaccgccatgtaaagggcagggtaagaaaaatggctataacggttatttagaaaagaggagacaggacattgaaatatgaaccggaaaagtttgaagcatcagggatacatgaggtgagagaactgggaatggggaaggatttatccagggatatctgcaatatgctgaacgctgttgggggtggggaatggaatgcagcgcgcttacccggagaatcagaggcacatgcggtggaaagaatgtgcagggaaataaataatccagagaagaaacaggaatttatgcagttctggcttgactatctgaaacgcaagcagccagaatatgggctggaaatacagattgcaagagtcctgacggaattaaatagtctgcccccaaagatacaaaacccccagatggatgtactcaaagtgctttgtgaaaacaaagagtttttggattcgcaaaagtaccagggagccattatctatcatattttaaaaatggaggcgcacggagaggacacctatcagggattggcagaatatgggcaggacagggctgttagtttttctccttctgcgcataagactgttgaatttaatattggatacgcatatacagataaatatctgtttgggctgctggaggaagggtacaaaattgctgcaatgacaatggacggccatttggacgcctgggaggaactgagcaggtggggcattggagcaatcccccataaaatgggggtagcggattacctggaatactgtaaagaaaacaacatttcagcagcggctattaaggctgctactgggtgggaggtattagatttatttaagatggcagaactggaaaaacaggactctgcttataaaccgcacctggagagcagacacaacagccgttgataaagaaataggtgaggtggaatatggaagcaaaacagacagaaactgagagattgatctatgacagtaaggagtatctgaaacgaaaccactttggagaatacaccctgctgtatatcttgaacaaggacagggtgaagggcagcccataccaatatgcagcagttgcgagtaccgatgaagccaggttatttttcaatgtgtacgctaaggaagaccagcctgatatttaccggattggaatgtgcagtacagatgatgacctgttctatgacttggaatttgatgattgtacgatagcagccatgacaatagagggccattatgatacatgggaggaactggctgacaccccattggaggaaattacatatttagggggactggaaacttatctggaatattgcagggaaaataacatcacaaaggaatccatacaaaaagctgttggcttggaggtgtgcgacattatggagagactggataaaaataagagtattcctttacagggaatggatgaggagtaccagcagctacagaaggttgtggatacaatcctaaatggaacagatgagcgtgatttgagattggcgcaggacatgctgaatggtatatggtctattgatcaaaaggaacctattttaaagcgcacggatttacaacaggctgcctgcgatatctgtattttagtccgggatcatatgccggaggtttgggcggaaaagctgcagtctggagataccgaagttgacctggcaaaagagacatacggcaggctggcaacattatatggaaggaagaccgaagcgcagtttctgcgaaatgctgagatgggggaacttccggagacggcccgtaaaaaaataagtgagattctggcggtattaaaaaagtatgaaaacaaggataagaagccgctatcaggacatagccggtaggataccgggcaaggaggcattatttgaaacaattgaatacggccacggaactgctggcctatctcgatgacttttctataccattttcactgaatgaggaacatgcccaggttctgttggactatatggagggaagtgcctatgggctacacgtagatgaaaaagggcagctctattgggtggatttagagggagaacaaatagaagaaatcaccatggacgaggttacattccttgcctgtgaatggaacaatgaattcatcttagattccagacagagactggaagagaaagctggaagcagtgaagagagggaaatcatagacaggataaaacagctaaaaaaagatgagaggctgttagacgatatatatgaacagacctccttatggaaacaggtaaatcaaaaagcgacaccggcgaagaaaaattcccgctgatagaatgaattatggaaagaaggggatgatttgggacgaattgaaacatctggaaaattaatggaatatcttgacgagtttgatatactttttccacttacccgcgcggaggctgaacaggtagtggggtatacaactaaaagtggctatacattagaaacagacggccacggacaattgtataaggtggacatggaatctggtgattctttggagacggatattgaccaggtgattgatgctgcgtgtgagcagaactacaagatgatatctgataccagggactattttaagttaagcagacactctgaatggcaaattcttcataaaaccctggaaggattgaaagcggacgagaaaatactaaatgccgctttccagaggacctattatcaaaaggagctgcgtggaaagatacaggaaatcctgcctcccgtggatatcacggctgggcggagatcagtaagatgataagtaaagtatcaagagggaaggaatatagctgattgctgtggttccttccttttcttttgctgtttattcgatgaaaggatgtgagtagagactgagaagcgtaaaaaagatgaactgccggaaagaaattcggctgtcatgcgaggaattggaggagctgaacaggaaggcaaaagagagagggctatccgattcgcagtatctgaggatgctgataaccaaccgccccagagattatccggaacttctggaagcattacagaatctcacgaatgagataaaccatatcgggataaacatcaaccaaattgtcaaaaacaacaacagcggcttataccatgaatccgataaaaaacgtctgtatgtttatatgaagcagatcaaggaggcagtcatgcaggtagtcagccatttggacatagcgggtaattaagtatggctatcagtaaaattctgcatatgggatgtgcaaaatcgggatttcaggcaaagcatctcgcaaatacgattaattatattacgaaggacagcaaaactgaaaatgggttgtatgtttcaggccataactgtctgccggagactgcactgaaacaaatgctgaacactaagcgaaggtacgataagatggggggacgccagggataccatatcattatctcatttgaagaggcggcagataccgttgataaagatgttgccatgaagattatagggaaatttgtagaggagtaccttggaaaagagtttgaggcagtctatgcgcttcatgatgataccgatcatatccacggccatattgcatttaatagtgtccgctgtattggagaagggaagaaatatgattaccgaaatggtgattgggacaaaatcatacagccgcttgtcaacaaaatctgtgaagagtaccatatggcaacgctggacatggataaagtacgtcagaacagaaagaaaaaaaaggaacgcatctgggaccagggtaaagatggtaaatttagttggaatgatatgatccgccgtgacatcgaccaggtggcggccgaggcggaaaactgggatgagttccttattggagtggaggaacggggatatgagataaaacagggagcgcatattctgttaaagccgccaggtatggataagggacgcaggctggataccctgggcggcgattacacagaagaaaaattacgggaacggctaagtatccccatatctgcaagagaaaaggaactgccggagccagtattggaactgccgcccagagtcaaaaaagtgactggttatattcccagaagaaagtccccattgactggataccagaagatgtattttacaaagttataccggctgggcgtcctaaaaaaacagccttattccgatgcttggaaatataaagaagatatccggaaacttcatgagatacaggagaaatataatttcatttcggcttatcagatacatacagacaaggacttggaaaatatcaggaaagcattggctgaacaggcaaaatcgcttaggcaggagaaaaagaaccaaaaagagaaccgtgaagccaatacagagatatttgagctttgggaaaagctccaggaactgaaggttgaggtttctttatatgaggaggggtatcaggaatttaagggagaatacctgcaggcagagcagctaaaaacgcagttgttggatatggggtacacgtttgaatcagcagagcggttgtacctgaatttccaggagaaaaatcgccggctcaatgaggttcttgcggaggtaagacgacagcagaggatagggaagaaaatcatgcaggagcaaaaggagagaatgcagagcagagacaagcagaaaagcagggaaagaggaggagaaagtcgtgatctatgagcaggataaactggaaaaactggcttctgaaataaaaaaatatcttttggaatgtaagctgggagacgcatatattgagagcttccgtgatttagtaccagcaggggggaaaatacctgggattagagcggtcttagacaatcatagattgagggaccatctaacctgctttttgatgtaccgttcttcgctcttaccagaccaggacagaaagcagggcgtgagtctggcagataaattagatgaggtcggagctgtcaggaaagcagataagaaggaagaaatggcggaagtggcatgggaactgaacgaagtgatgaaggaaacagactttatccattatcttgatgcaggatacatgagagccggggacaaccagtccgatccggtaagacgtatctacagggatattggagaccgggaaaagcgccaggacatcatagactatttagagactgttttggaaaaagttcacagtgaaaaaattatggctcttatttcttctttagagaatataacggataaggttccggcccgatcaggaaaggtacggtaggggattgcttgatatataggaggaataatttgaagtatcaatttttcgacaatgatgggaaagtgactgaatcagaacaaaaaagttatacagacgcactaaaatttgcagaggagcgaggcattacatgcctatccatgccatataagctattcattgcgtcttttcgtgaaaaaatcaaattgctggaaagccacacccagtatagtaagatttcggaatatgcagaaaaaatgattatcttgaaccagggtgcaggatatcaggccatagctgcgaatgatttcatgaaaaaaattattgtaacaccgattgacgatattaggggatggcttgaggaacatggaaaaagcgagtttgaaccagtatcccaggattggcaggaaggtaaggcggaaaaacagaaaaataaagcaaattccccaaaagtaagataagaaatgaatcgagaggcagccgattggattgtctttttttattgcaggaggcagatatgacaatagaagaacagaaatatttagaagagtgccgtaaaaagctgggggcggaccagattgaagtaatacagatggctttccaatacgggctgggcattaaagacgtgcggcgggttgcaatcccaaagcttaatgcggagcagatgcgtcagaccgtttttgcaatgcttgaagatgtagacggggaactggttgatttgtgctgtcagggcacatttgaccagtaccagataccggaaattgtttctggttccgtctctgggcttacgaaggaagaaatcatgtcctatgcgacaccggatctgccggcgagccggatgaaaaaaatgaggacacaattgattgaggccaaaaagaatgctggtaattccgcagaaggcgcggcgtttaaggagtatacagaaaacctgataaaaatgatggagacatctctgcagcagtttaaagagaataacgagaagtttgaggtgctctcaacactggtgaaagaacacgtcctggacgagaaaaaccaggagattaaggatttatatgagaacctaaaagataaagacagtttgatcaaaaaactgcaggaagaagctgcggtgcaggaaacacagataaagaagctggaggaggaacttacagcggcaagaacacggtcaaatgccgaagtggttgagggaaagacagagaaggtaactgcacctaccgttcctccatcttattggagaccgcagccgccgcagacaaaaaaaactatccttgagaagctgttcccgcagaagacatcggatattctggataaaatcgctgcggaaggattatcgtcagaacaacttgaagaagtcaggtctgcctttgattcaggattggccgatgatgaagtaaagcggattatcaaaaaggaattgactgctgataaaatgcggaaaatgcgtgagattatgctgctggtacgggaaaggagacatacagatgcgtgaggctggtgtggtgtcattaaatatcagaatggtccgggagtgctaccaaatgatggatttaatggaaaagcaggactttgtatttacccaggaggataaaaggatacttttaggttatgcgttccatcagcaggacttagactgtgtgcatgatgcggtcattcatatcgctgcggtcagggaaaaggaaaaatcccaggggaacctggaggctgggattatagagcagtatgccatccggggcgggagcgaactgcaggagagaatcaaagagtatatcatacagttagaagtggcaaatatcaatcaggaaatagcaaatcagttacttgtgaaaatcctgcaggataagaatgtggactatgaactggaccggatgctggaggagctgcggaaacgcgaagatgaaaagaaaaaagagaatgaagcagttaggaggtgagttctataggagaaatacaggaagctacccaaatcctgcgggtgtcatttgagggaattgagatattcatgaaaattgtcggaggcgggcttcatacggctaaggatattggaaaattcatcggcaggttggtggagatggaacgtttatccggaaggacaaccgtaaaagaccttcttaaaacaggaggcgatttgcaggttttccgttttgatacgactgatattaataaggtgaaaaagctggctgataaatataaaatccgctatgcactccttccagatatcaataaagcggatggtaaaagtgaaatcctttttcattctgatgccacacctagagtgaatcaaatcatgggggacatcgaggggagcaagattgaatcaatccaggattatctggataacggggaggagaaggaactgaaagagacttacgggatagacaagaaggatatgtcggacccaaacaagcagagcgcccctaaagaacagtccatctctccatggggatttaaggcagttgggacatatctggcacagacaccaggggcgggtgttggggaaatcagtaatgccatagatatgccatgggcggaagtagagcctgtactgaaatatatggaaagcctgggaatcctggagatcaatgacgatggcagcatggcctttaaaatggacaaacaggagtttgctgcgtatgagaaacagggaaaatggcagcatgcggaggacatggagcctattgtgcgggggatggagcagccgcataaggcagaggctgcacagaagcagatgtctgagatgaatagccgccagaggaaggtactgcagcatgcaaaggaagctgtcagagacgatccaaatatccatcagatttttattgccaggagccttgcggtggaagagactgaaaagagaattctcacacggattccgttcaaaaagaatgagtacctgtggatagataaaaattccatatcccatatcagtgaggagaagaggaccatatttacaaatcttcagaaggataaggaatacagtgtggtgaataacgaggggcaggtgattggaaaacgcaccggtgaagagctatacagccagagttatgatccggtcttaaaggaaaccagagacatgctgcacaagaaaaaagaagaaaaccggaaactgcagatggcaggccaactgaaaaagcggggaggaaggtaatggaaaataagaaaaaaacttctgtctggctgattgtacttggtggtgtgctggcggcatatggcgggtatcttcttaatggcatctgggaacaggggattgatatcaatacctttatggagcgtcttaacatggttatggcccgcccatttggaaattactttaatgatacaacttttaaggggatattacttgcagaattcgtatatatgattgcgattgccatgtatctgaccagcaggaaaaactatatgccgggaaaagaatatggtacagccaaatttgcagatatcaaacaggtgaatcaggtgttagccgagaaggacgagacagagaaccgcatactaagccaaaatgtccgtatgaggatggattcgcgtaaaacgaagctgaacttgaatactttggtcatcgggggaagtggagcgggaaagagtttcttcttttgtaagcctaatttattacagcttaaccgttcttcttatataatcactgatccgaaaggggaaattttaaaagcctgcgggggattcttacagaaacacggttatgttgtcaaagtcctgaatctgctgaacatggaagagtctgactgctataatccatttatgtatatccggaaggaatcagatgtcgtaaaattaattacaaacctgatcgccaatacaaccccgaaaaactcccagagcagcgatcccttctgggagaaagcagagtcgctatacctgcaggcgctgttctactatgtttggctggaatgccccaaaagtgaacagaacttttccacggtactgaaattactgggagaagcagaggtacgtgatgatggctcgccatcggacttagaccgcaggattaagcgcctggagcgtaaaaagggaagcaatcatccagcagtcaaacagtattataaagtaatcagaggagcggctgatacggtccggagtattgtaatcagtgcaaattccagactggcttttttggaaaatccacaaatcctccgtatcctggaccatgatgatatcaatatcccggagataggggtgggaagaaatggtgacggaaagacaaaaacagctcttttttgtgtgattccggattccgataaatcgaacaacagcattgtagggctgctttacagccagatattccaggaactgtacttccaggctgactttatttacgaaggaagattaccaatccatgtgacctttatgcttgatgagtttgctaatggtgtgacacgttctgcgtccaaaacggtagaaataaccgacaaaaccgcagcctgaagccatgaatggctttggagaactgcataactgaaatctcaaatgatggggtaacgcccggaaggggattcactgatactccgagtagcgtcagccagatacagtggctggggttataagcgcgggaaagtcgtgcgaagcacaccctaacgctgaaaggcgaggaaagattcatagaggtatgagttgtgtgtgacagtgcgggtggggctgccatatggctagaatgacccaaaggaggtctgacaaagttccgaatgtacggctctaaacaaatagcctgtagaaatgcaggtgtaccaggggtacgcaggcggggcaaagtaaaatttgttagtatgaaatgccttctgtgcttatagggcataggtatcttgaggattttccttgaagataatgcttgcagggctaaaggagcggcctaagtggtagcaatcctaagttatgtggaacgtggaaagcagccaatacgggagctgactgtatcagcgacaaagtatcgtagttgcagcgaaaaggaagggggagaaaaacttctataataagtgcattagtggttgtgagagtagaggcacagtaccagggaaaccgtgataataagcggtggagggatagcctcaagccgatactaagagattatgttcttagtcgggggagcgccgtgtgatgggaaactatcatgcacggtgcggggcaggggaaaaacccgaggcggcagtgccagaggtttacctattgccatttgcattaccggatgattattgcagtttacttagtaccatgaggtcacgagaaatttcatcgatcattattatacagaaccttgcgcagattaaagcattgtttgaaaagacatgggaggtcatcccggggaactgtgacactttggtctaccttggcgggaatgaacagagtacacacgattatatttctaagatgctcgggaaggctacggtagataagcggagttctggtgaaacaagaggaaaaaatggcagcagcagccggaactttgatgtgctgggaagggaactactgacaccggatgaggccagaaagctggataataaaaagtgcctgatctttatccggggatttgacccgattgtagattcaaaatacaataccccggcgcatcctcttttcaaggagacgtttgatggaggcgcaccaccatatcatcatacaccaatccgtgagaaaagtacagtgccagcctgcgaattgctgaaccggcagtcttttgaatattatgaacgccagagggaccaggggctgaatgttcagatagatgaaataacactggacgaattgctgtcattgcaggaacctgatatgccggcaaagatattttcagaagatgaactgaaaaagaaccgcaaaataactgaaatcgagaatatagaaaagcaggatttgggacagattacagaagagcagtttaatgaaatgctaataaataatgattatacattagagcagttagaagaaatacgtcttggattggtaggaggtctttcctaccaggatatattgacttactttaaatcagataaaagtgccggacaaatgcgtgaaatacgcgaacaactgaccggccatcaagaatcttaattttccctatatttcttatgcctaagatggcagatatatgggaatctgttgcaaaaaatagagggcgcacgcagcaggttcttttatacctgctatttttgcgcccttttttaaagaaaaggagattttaagtgaagaatttgactgaaaaaaagaaaaaagcaaaaaaaatgattaacagaatcagcagtataaccgctggggcagccatggcaaccatgttatatacaacaaatgtatatgcgtctggcgcggaagtggtgacggcacctttgaataatctgaagaatctcgtaattgccatcataggtgccgttggcgtgattatccttgcaaaaaacgtaatggagtttgcccagtcttaccagcagcaggattcgagttccatgaattctgcgataaagggcatcgttgccggcttgattatggcggggattagtacagtcctcacgttcctgggtatcagttgattgtgctgttttaatgaaaacgtggagggaacactatgctggagttaaggcgcgtagttttttttgttgatataggagacaatttacttgaaaaggcaaaagccagtcaggaatgtagagaagagtgtaaaaatttattcataagcctgggattccaggtggataccgattacagagaaaaaaacccaaatttctatactcaattaggatatcatgcaaacgagttttatgttgcaaagggagaggaacatttgcggataagggatttggagatatcgggtaatatatatcctgactcactggctgatatagcgaaaaaattgcggaacggtaaaacctttcactataaaggggccattgatttgcaagcagcctatattcttactgaacttgaagcgaaagattattatgagaaaaacctggaagcatacgaggaaaaggtaatcgaagccatgaaattaaatcacgaaaagtgtgaaaaaacatggttatacaatcctatggctgaatttaaggaggatattcttatctgtgttggttatgatgccattagtttttttcatttgaaaacggctgaagttatcaatgatatgttggataaaggattaattaaatcggacaattcactgctcgcaccggggtatgcacttccggagttttacacggagacgggtaaatataagctgccgcatctaaggaggtagtgatgcaaacaaatttcaaggcttttgttctttcaaaagaattattttaaatgatactctagtaatcataatatccaaatacggaaatgaggtgatggtaaatggatatttttaatttgggcgaggcaatcctttcgcttcttgaggtcgtgttcggcttttggaacgggcaggtgaacatggtgtttgaactgctggggcagtccccgacttctttcaaaggaggcggcccatggggagttataaccgggattgaaccgattttcgttgctgttggttcaagcctggttgttttattttttgtgattggtttttgttcggaaagtgtagatgtgcgggaagagatgcggtttgaagtgattctccgtatgttgatcaggattggaatcgcgcagtggctggtggtatacaacgtcgatattatgaaagccatatttacaagtgttgggaatcttgtcggactgattggagggagtgaagccacacaggttacgatagacccggcgcaggcagatattatcaagaatctgggatttgtggaaagccttgtatttttaatcctggcggtatttttaagcctgattattttgatctgcggatttttccttatttataatgtttatttccgatttttaaaaatacttgtaatcgtaccgtttggcagtatcgcttatgcaacggttgcaggaaatcggggagtgagtgccacaagcgtacagtttacgaagtatttcataagcgtagtttttgaggcggtgactatggctttggcgattattctttgcaatacgtttatcagttcaggattaccacaatttacaggagactatgcagattggacaaagactttgatctatctgggagaaatgacattcacggttgccctgactgtgggaagtgtaaagggcgcccagagcctgacaagcaaggccctggggctgtaagtaaaggaggctttgggtgtggaaacagcggcgcaggataaaagcatacaaatgacgctatttgagtatttcgcagacgtggagcaattttccctgaaagatgcaaaggaatgtgtataccagtatgcggaaaaggatgtaaaggaacccagcatccgggcgcgtatctacgaagggattaataaaggtctttttaaacgggttgccaaaggcgtctatacggttacgaagaaaaatgcagagaatgaggatattacctgcatgctcatacagggaaatggacgtgatctgagtttccttgaggataacagcattgacgcaattatcactgaccacccatatctgctgaaaaaaagtttaaaagggggaaaccgggactttgcctcctatgatttgttccagtacacacagcaggatttggacgaaaaattccgtgttctaaagaaggggcacttcctcgtggagtttctgccggaggaaaacggtgataattacgaatatctttaccaggtgaaggccatggcgaaggaaagcggctttgaatattacgcgaaggtggcatggcggaagggtacaatcgttgccaatacggggcggaaggcaaaaaatactgaggatatcctgctcttttcaaaaggacgtgcgcgtgatatgcgaccggacgcaaagaaggacaaggcagaaccggagatgaaacactatatgtccggagcgaaagggatgcttcctacggcttttgacattcagccaatctcaaaagctgatagggttcatcaatcggagaagccggtggaactgctaaaacagatactggaatttgttacagataaaaaagaactggtattggaccaatatgctggttcctttgcccttgcggaagctgcccttgaatcagaacgggattccatctcaattgagattagtcaggaatattttgaagaggggaaaaagaggattgaaaatgtaaagaaaggtaaggtgagataaatggatatcgaaatcagcagggatttacagcactataaggagagcttcctgatggggctgaccgtgaagcaatttacattcagcgtcctatccctgggggcgggagcgggaattgtactcggtttatacgataaaatcggcatgacattagcgtgctatctggcaacgcctgttgtggtgccgattgcactcacaggattttataatcacaatgggcttagtttctggcagacggtggggagaatggtccagatgtcttttttcaataagccctgtttataccagtccacggaaaatgtggattggataaaggacgcctatggagaagagcagaaaattgctacacagcagcagaaaaaagaaaaaaaaggactgtctgacggacaggaggattttaacatggtaaagaaaaaagcaaagcgcatgatcctactgacagtgggggctttagttgtggcagtggcagggatacttgcctttaggctcatgaaataaaagatatgaaataatcccacatatgtgggaagtagtttagcgaccagcaggttacgggattcgctaaactacttcccgtagcctgccttggattaaaggaggtttacggaagtgggaatttttacagatcgtttcatacagttaaaaaaagcggacaaaccattgtttgcagccccgaagagtgttcagcagcagattgagattctgaggattgcaaaggatggtatttttgagaatacaaagaaccggtacagcagggtataccgttttgctgacataaattatgtcacggtgtcggagggagaccagtatgaaatcttaaagcagtattgcaagctggttaatgcgattgatgttgcttttaagattacaatatacaacaaaaacaggaacatgagccagttcaggcagaatgtcctgataccagataaagatgatggctatgaccatcttcgggacgtttacaatgatatcgtagaggaacggattgtagcgggaaaacaggggattgaacaggaacgctttcttacggttactgtggaacggaaagattatgaacaggcaaaagcattttttaatacctttgaaggagggatgcagcaagaattccatgcgataggctcaaagttggagccgcttgacgcggcggaacggctccgggttctgtataatttttatcgcattggtgacgaagaaacattttcttttgattttgatgcgtatgtaaaaagtaaaacagattacaaaaatgatatctgcggttccatgattaagtattccccgaatgactttgaaacagaccggaaaatctgcagggctgtattcatcagaaggtatccgacaagcctgccggacactttcattaatgaaattaccaatgttcctgtacacagtatcacctctatagatattgtgcctgtgccaaaggacctgacaacaagaacattgcagaaaaaatatctgggtgtggagtcagatattttacgccagcagcgtgtccgtaataaaaacaatgactttgcaagtgacatcagttatggaaagaaagtggaaaagaaaaccctggaagcgttgatggacgatgtacgggagaatgaccagaacctgttctttgcaggtgtaaatatggtactgattgcggataccagggaagaacttaacagtattacagagacaatccagacgataggaaacaaatatctctgtaatatggaggtacatcatctccaacagcgagaggcattaaatactgctctgcccgtaggggtgcgacaagtcgaaaccatgcgcaccatgcttacacgggatatcgcggctttaatgccttttaatgtgcaggagatttatgaacccacgggcttatgttatggaacgaacaggatttctaaaaacctgtgcgtggcagaccggaaaaaactgaccaatggaaacgctatggtatttggcgtacccggcagtggaaaatcctttttctgtaagtccgagatgttgggggtatatttgcagacaggtgatgatatcatcgtcatcgatccgacactggagtattttgatattgcccagaacttagggggtgtatgcatcaacctgtcaaattacacccagaattatataaatccgctctggcttgatgtgaatgaattggaccttgccgacagtaaaggactgatccgagataagggcgaatttatgcttggtctgtgtgagcaggcgatgtcggaaatgctaaacagccggcataaatccatcattgaccgttgtatccgtaagctgtatctggatattgccatgagcaaggaaaaatatgtgccggttatgtcggatttttatgacctgctgatgaagcagccagaggaggaagccagggatattgccttggggcttgagctgtttgtaagcggttccttgaatattttcaaccatcaaaccaatttagacgtagacaaccggttcattgtttatggaatccgtgatcttggaaaagagctgagtgcgattgcgatgctggtcatgctggaaaatgtccgggcacggattgccagaaatgcagaaaaaggaagagctacatggctatacatagatgagtgccatgtgttgctgggaaccggggaacattctggacgcagtgaatattcgggaaaatttctctattccctgtggaaaaaagtaaggaaacaaggcggcttgtgtaccgccatcacccagaatatttctgatatgctccagaattacacagccgtaaccatgctggcgaactctgaatttattgctttgttaaaacaggcaaatgtggacagccaggagctttcacgggtagcggggattccggaagcacagttgaaatacgtgaacggctgtaattccggtatgggaatcctgaaacacggtgaagtcattattccttttgatgccagggtaaagaagaataatatcatatatgatttgttcaatacaaatcttcatgaaaaaaacaaacagggaataaagacggatgaccagtattcataattatgagaggtaaggaaatggaagaagagaaaaaaacattgggttatgattgggaatttgggcatgaggagctgatgcttgaagttgatgcctatcgttatgacaacagactgtatatcggtcttacccatatggaggagggatatgaggaatcttttgctgatctgaccatcaatctggctcatatgcctgtcgaaagaaatgaggcatacattgacgcctttgccagtaaaagcaaactggactttattaaaaagcacaaacttggaaaggtgcttccggaaatgggttattcgggcatggaaagttattataaggtggcgtttgaccttaaacgcctggaggaatttgacagggcaggagtagagagatactgctccatcaatggaatggcaaaaccagagcagacaaaggcaaataaaaaaccaccaaagacgaggtagaaagattggaggaacatcgttgaatagagatatctttgtgttagtagtaaagcatctgctggaactgcaaacagacggggaacttaggacctgggtgaaatgggcggaggactgtgttgccatggggcagtatgctggttttagggaactgccgcaaaataaagcggtagagaagtggttggattcctattatcatgttttttctgctattcagtctgagtttagcaaggaaacggcgattaaggtcctgaatttatcacaagagaaattgtgcttgtatccatatgagatgcgggcagcggcacgggtccttaaggctggagggacaggaaaggatattttacagatgattgtcgaaggaacattggaagatccagaacccgttgtgccagaacattgcgagaagggaaagatagaagaagcggatacatggtcctgcaatacagaaacattggactgtatcctgcggagtgtgcggacctggcaggagaatccggaaatccctcttttgtataagcgtggggattcactggcagaacagcttttcaacgcctgtttggagctgttacagtatgaatttgagataacatcaattccaaaatccgattatgatttgatatccgaacatgcttttttcctcgtaaactcttaccaggtccttgaaccggaagatattgacctggatgcaatctttgagtgttttaacgatgcaaaaataaatgaacgtatgattgaagcagagaatcgggataaaaaggaaaaggtaagcagtatttcaggaaaatcagaaaaaaagagataacaggaggcagctatgatggaggtatcgttgaatgttcccttgggggaacagccgcatttaaaagaaatgtttgccatgatggaggaaaaccgcatggacgcgcaggcgcagaacctggaggattttttacagtattttaaccagatggaaaagtattttgaggatatgcaggacgaactgctgtatctgcgcgggcagttagacgaattaaatgataaaaccctgaaagctaaaatagacaattttgtgaaggcgtccggagatagagtgcacgcagcgaaagtatggctgggagctttaagaaatgaggtatcggaaggcattaaacaggcagtggggcatgtaaagaggcatgtaaagtattatggagaacaggcactatacacgtttattgataaatcaaaagcaggcagggcgctgtcggtaattcatgagcatctggaacaatctgccaaaaacctggaagatggagcacggaccatgggggatattgggatggaacttagcgcagcgaagggacaccggaaaaatgctaaaaatcttcttatggggaaagatgcagcggatgtttttgagtatgactacgataagggtattgtggcaaagatcaggcaagccatagaattttgtgggaaaattgtgaaaagtatggcggggcacacagaaaatatgcagaaatcattggacggttttacgcagagggctttggataacagagccggacgggatagtaaagttcctgacagtatggaagaaaagatgaaattggctggacatgggaaaggaagataaacatcatgcctgaaatgaaagtaaacggggtacaaaagttattccctccaatagagtgtagggttttgaagacaggaaacagaagcagatggatatctgttaatctggatgatttgaaacatgatcgttttgaggaagtcaaagccagtgtagttgcaacggttgaacttgcagacccggattttgacagattgtgttaccgcggccttaattcgcacgactatcccttcgtaagccaggtatatggtaggaaacgaaaaatactgaagaatgaggctggaagggatgaatttgaagtgatacgcatagaaaatgaaaagatggactggctgtacatggcagtcagacagtatggcagtattccacttttctctaagcagcttcttaatatggaaactttacgggattgggaacaaaagtttgatgctatggagaaatttgtgagtgacaacaaaatagggtacttagaggataaactttactttgatccggatataccacccagtagagcagatttaatattgtcggccgtgcgcgatgggcgcgattggggagattccttcgagggcagtttgagtctgtattctgctgtgtctcgccatattcactcttccatagatgaagcggcagaaaagtatctggacaaaatatacggtagcacacagatacaaacacataaggaggcaaaaagatagatggatagccaggataacaataatgtggaaatactgacacagagcgaacttactatgcgtataaactgtattgaagatggtgagttactggtgatagataggaggggtgcggatgaaggcaaatgggctgaaaatggtaagtattcgtctggttgatgatccacccatatacagtgaggataaaatccaaaatccgaatgatgcagtccaactcttattaaaggaattcgattctgttgacagggaattatttttcgtccttaacctgaagaccaatgggcaggtgatcaacgtaaatatagccagcatggggacactaaatagctgcatactctccccgagggaaatctttaaagccagtatcctttccaatgcggccagtgttatattaatgcataatcacccatcaggggactgcacaccttccaaacaggacgttttaatgactaaaaggcttgtggcttgtggagaactgattggtatcactgtgttagaccacgttatattaggaaaggaaacctatttaagtatgaaggaggcgaatatgatgcccgatgggaagaaaatatataatgaaatagctgcagaaaacggagtagagtatggaaagaagccgattcccacaatatcattttacgtggcggaatgtatggagtttccctcgttggggaaagtgtatcagtgcaggagcctggaacaagctgtgaaacgatacaggaatctcccggaagaaatggcgtgcatggggaatgggattggattcacaatcaaggacgatgattctatctattccggtgagtttgatctggtgtcagcaaaccggctggatgtggatattatcaactctatcccatattatcgtgacagcccattggtacagaaagcaattgaggatatcaaacgactgatgccggaagtgaagattattgaaccggtacagcacggggtacaaaatccaaaggagcgaaagcaggccagataacaggctttcatatatgcattgaataaaagcaaaaaatacggtacaatatccatataaaagataagacaggagggaatcggcgtggataagaataaggaaatgtttgacaggctggtaaagggcctgcgtgatatttacggtgataaattggtaagtattttactatatggttcatttgcccgtaaaaccaatacaaaggaatcggatattgatatagcagttctactgaacggaaaagaaacaaaagagatgcatgaccgtatggtggacctggcggtggatatggatttggaatatgatcaggtcttttccattctgtatattgactataaaaactttttggagtgggaggatactttaccattctataagaacgtgaaggaagaaggggtggtactgtgggcagcttagagacattagcaaagtaccgttaccagcgtgcgttagaggatttagctgcggcaaaagaaatgttgtcaggcggtatgtataaaccatcgctgaaccgttcctactattctatttttcatgccatgcgtgccattacagcactggaaggatttgattccagtaaacatagcggcgtgattgcgtattttaaccaaaatttcgtgaaaactgggatttttgcgaaggagacttctaaaataatcaaaaatgcctctatcatgcgtgaacaatcggattactcggattttttcattgcctcaaggcaagacgcagaggagcagattgaaaaggcaaaggagtttatcggtgagattgaaagatatttaaaggataaaaatgttctataggagataaaatacaggcgcaccagtacgttgtggctgtctggaaaacggtctgtggataaataaaaattgaagaatgtattacaagaaaaagtggttgcttctagtggccactttttttattggaaaaacggctgcgaaaatttgcagccgttttttgcagaaaggtgggttgagaatatgagatttggattcagtattggatttcaattgtatgagtgggaggttgaaatcgaaataccgagagaataccgattccgttccgaaagggaagcgcggacagcctgcagggaaatgaatgtggaggctattgtgtttccaaatcagatcgccgtcctgtttgaacgggattatatgatgctggaagacagggagttatacaattttcggaaactcaaggatgaagtatatgagaagtgtggaactttacttactccggaggaagttagtgaactgattgagaaaggaactttagaagaagtagtccttttcagtgataagtatatgcctgacggaacggaatacatggaactggatgtgtcggcagaggaagcatacaaaatgttgaaagaaaagtatgatccacattatcagcttccttttggtttctgcagtcctgcaataaagggtgtaaaaggattccactttgaaagcctctattatcaggtgaaaaagatatgagcaatagctgaagggaggaatacgaatcattgacaaccgatttaaaagtaaaaaagaagcacagataaagctgaaggcagacgcagaagtaaaattacaaacgcataattacctgggaactgaaaaaagttctgcatcgggacttcttggaaaaaagattgtttccgggggtatagatgaaaaagcctcattatcggataaaaagatccacatgaagtccacggagattcatcctgtatcagagccgaaggaacaagaagataagaaaagtgcggttcttgcagcgaattctgtatcagggtttagaaagcagccaggaaagaaagagagttccctggattataaaaatacagacaggaaacccagacaagagaaaaagaagtcaggtcaggaatcacgccaggaatcaagggaagaaacttatcccagatatttggctggaagtgagaagaacgcagattttgaagatgatggagtgcggaagagtaaggagaaaccaaaagagaactttgtccgggaaaagcagaagcaaaaagccagcaaagatcctaagtttcacttagacaatgtttccgggccggatattaaacggaaagattatgattttggatttaaagataccgtgaccctcacacgaacggagcgagggtctgaagcagtggaccagaagtctgaggacagatttcaaagtcaacaaatgccgggagaggaccgggatacattaaagaccagaaaaaaagatgagaagatatcctcaaagaatgaagtaagacgaggaagggtaaaaaaggaacaggaaaatacccggatgaaaaaagctatccggaggcgcatgtatgctttcatggtgaacaagctaagcggtgaggaacaaaaggacagttttgcaaaagccgcaaaagatatcgccgtcatgagggctggattggttgtcaaacagcttgttttgtatcttctggggctgttggggccgttattgggagggctggttacgattgccttgccctttgtcctgattattgtaatcctgtataacacccctttggctctctttctaccaccattacaggaaggggatacggtacaaagcgtattatcggagtattaccgggaatttaacgaggaagtaagggcggcggaagaagacagtgatgaggatgtaacctacaaaaatatgcagagtggcgtggctcgtagcaattttaccgatgtgatgatggtatatatggtgcgttatggaaccgggcagggaaatttctcaaccgtcatgagtgataagaataaaaagcacttaaaggagatttttgatgaaatgaaccactttgcatctgagacagtgacagatacgatccgggccggtgaaagccttggaatcatgacattcagtggttattgcaactgttctatctgctgtggccaatggtcgggaggtcctacggcaagcggcgtcatgccgaaagcagaccacaccctggccgttgatgcttataatcccacgcttcctatggggacacatatcatagcaggcggaaaggaatatgtggtggaggataccggagattttgaccgttatggtgtagactttgatatgtattttggagaccatgggacagcccagaattttggacatcaggatatggaggtatttttggctgattccaatggcagcaacacggtggaagtaacacacacctcattatatgtgtacaaccttacctatgaagattatattgaacttggcaaactgacacccagtcaggagaagttgctgcgtgaggtcatgagtgacgaattcctgcacagtatgcctgcaagcggcattggcgagcaggtggcacttgcggcgttagataaggttggctgccagtatagccaggatttgcggtatgaggaaggatattatgactgcagttctctggtacagaggttatatgcagaatttggtataaaccttccatccgttgcatcaacacagggacagtatattgtagacaatggtctacaggttagtgaaaatgaactacggccaggagatttgatcttccattcccgtgatacaaatgcgggggaatttatgtctattgggcatgtggcgatttatgtaggaaatgggatgcaggtggacgcacgagggacagcatatggcgtggtttaccggccattggttccgtctaacatcggtttgtatggaaggccatgtcggtagcatcagcatacaaatttgctttgaagttctaatcgtaatgtaatttaaaggtaatgaaactgaggagggataaacatgctgtaaatgaaaagaagaaatcaataagaaatgaagaaaaaattgagggcagtcggcaagactgcctttttgaaaggagaatgccaatgtctgactatatggaggacaatttttattatcttgaaaaggtcaggatgaaaggggaataccatgtaatactgtataaagcctggatggggctgtgggaggcacgggaggcgtttctggacggtctgcaggaaggtatgataaacaggcagctagtcttgggagtagaaaaggatggagagaaaatcccatttttccagtgtgatgatggtaaattctatataccagaaataaaatccagagatatgctagggaagcctgcagatacattactggaagaattgagtgggcgttttgggatagaagaatgtggggagaagcaagttgtttatataagcgataccaaagaacaggattatgatatccgcataaccgaaacattaagtaaaatagtgacggtcagggcacagagcatggaatcatccttatcagaggcacatgacaattattcggacgcaaaaagtggttatgtattggattacagcgacctgcggggtgtaaccttgtcaatggtgggtatccatcgggaaaagccgcggaatatgggtgggagatgagtagggaaacattaaaagaaagactggaagactctttttgccgctgggacaaggaactattaagtggaggcagtgatccttattatactgacgggcaaaatatgaacctgttaagaaaccatatcattagcgcgaagtatgatatgaaggaggcaggggaatttccagaaatttaccaccgaaagacaccggagaagctgccggaacattttatggtacaggcggaaaagatttattgggcagccgttggtatcttccgtcaatgtagggacgatgtggactatcagtatttatgcggactggaactaagtcctaaaatggataatgggcttgaaatcagaaatgcattaagaaatgtaagggaattggaggatgcaatcaggaaccaggattttgtcattatgagaaggcaccgtgagatacctgattttaaaaaatacagacagattattgaaagcagcccagagaaaatagaacccaaaatggaacagatgagtttatttactatggcagaccgggaaagaaggtgaacctatggatcagcacaccatgaaggtatcagatttgtatgatattgcaatttttgatatctcgcgtgacggtgaacagtggagaaaatatctggagttttctgccagggggaatttatatcgttttgactttttgaatacatgtatcatttacgaacaatacccggaggcagaaatcctcctgggattttcagactggaagaaagcaaagcgttatgtcaggggcggtgagattggaatcgcaacatttcccattgagatgctgggaggtgcgcagtatgtctatgatatcaaaagcaccggcggaagggttatgccttggatatgggaaatcaatgaagaaaatgctcctgcttttgcaaagaggctatttccagaacaatatcaggaagaaaataatttcaggatagcaataaaaaactttacgagaacatatgtacgtgctataatggaagaggaaaacgacaggattcatgaaatagcagttcttaccagcaaggatgaattggacgataaacaaatgtcaccagttgaagaattcatcctgcagagcaccgcatacttggtattaaggcgatgcgggattgatacttttgatacaggactgtctgcaataacaaactaccaggaagaggtgatactatccaaaataggtatcctcatatcggatattgcagagaggacgttgcggagatttgcagagattgcgaaagagatccgggaagatgaaaggagaaatcaagatggtagaactgaattacaggaaagaaaaggacgggctgctgtacccgatgctggagacagggagccaacaggcggaagggctggagacgctgggcagatacgcgaagctggcacaggaatacctgctggagaaggaggaaagccggtacagcctgttgctgcggacgggcaaactgccggagctgctgaaacagatagaggcggaagcgtgggagctgcacgaccagatcgtggaggactacgtgaggataaaagcggtggagaggaacatcaatccggcggatacgatggagatgaccagacttcgaaacgaagcagcgatgatagctcaggaaaccgtgatgcaggaagtaatctgcaagccgaggtaatagatactgatatagaggaaggaactgctgttgcggttccttctttttctgttgaaccagtgcctgtagaagtgacagatgaattatgcagagaagtggtattagcaggcgcactggaacctatcctaaagaaaaagatctatgatttctttgagttaaatgaagggatagaggagcgtgttgaatttctttatcagatttacgaaggtggagacaccattattactggtgagggacttgaatttgaatatgagacagataatacgggaatccagttatactggcatgagcagaggcagtatctaagtgggtatcttccatttaagatagtggcagaagaaatcctattattaatcgaaagcggggaatactatcagccaataaaaaaggacgtggaaataccggaatcattggccgaaacagtagaaaatttcctggaaacggcagatggcaggatagtatttgacatgatttatgatgtaatgaccataaacttactgccccagcaggaaaccgaatttatacggcagagtttcctttccctgcttggttcagatgtggattggatatttacctcaacactgaccttccatgctggagagatttcttgttcttttgacggtaataaggtgcagacctatccgtggcgtgtgatccgggacattctggcccggataatcgaattagatcaatatcctgaatccagccaggatttctctgtagaggaaattaaaagaattccctggtttcaaaatctggcgtcccaataccaggggttattagaacaggccggcgagacaccggcagtaacaataccatatttaagtgcggataccgtaattgagaaagatgacaaaagaacagaggatacaggagaagaaatacaggagacccaggctgatggaagaagtgaacggttaaaggcagtatttgaagaggctgcaaatgcatatgcccttcattccatggcattgattccctccaaaccattgattcaaaggttctttgaacaggcaggggaaaaggaaaaacaggaatttctttcaaaaattttgaaagttcagtctaagcaggactatggaaagtctgcgctaaatacaagctggggattgatccattacacgtatggtgaaagtggagtcgttgaattccgccttgtgaatggagaaaatgaaggacatggggcttttaccatgcaggaagtatcgcgtgcaatccaggcagccattgatgtgggagagtacctgccaccgggggaatatgaagcggcacgcaaagaagaatttgccctatgtccggaagaaaccttcctattatataaggaaatgagtaaccgaaaccaaaacgtcattcaggtttcggattttttttaccctgatggatgggaattcccttccggtgacaagacaaagtataagagtaatgtcgcagcaatccgtctgttaaaggaactggaacagtcctcccgcccggctacaccagaggaacaggatatcctcgccaaatacataggatggggaggtcttgctaatgtattcaatcctaagagtccaaactggacaaacgagtatcaggaactgcagacgctgttgacagaggaagaatatgagcaggccaggggaagtattaattccgcattttacacgccgcccgttgtcgctaagtcaatctataaagcattggagcagtttgggttcacaaatggttccatcttggaacccagtatgggcgtcgggaacttttatagtgtcctgccggaagatatgcgggattcccgtctttatggagtggaattggacagtatcagtggaaggattgcaaaacagcttcaccctcatgccgcaattgaagtcaaaggatttgaaaagacaaagtttgaaaaggacagctttgatgtcatcgtgggaaatgttcctttcggcgcgtacaaaatttttgatcctgaatataaaaagtatggtttccgtattcacgattattttttggcaaaatccatggacctgcttcgccctggaggaatcattgcggttgtcacaacaaaattcaccatggataaagccaattccacgatacgaaaatacttggcggagcgtgcagactttatcggcgcggtacgtctgccagggattgccttcaaaaaggacgcgggagcagaagtgacatctgacattatcttccttcaaaagaagggaagtgtactgtccacaaataaatcagaggaatggatgaacatcacctataccgatgatggggtgccggtcaatgagtattatatgaaccatccggaaatgatgctgggaaagatggcttttgacaggcatacctatggtcaaaactctaattatacagaactgatcgtagaagatgaggaaaattttaatcttgaagaagatttgaatcatgctatttcttttctatcagccgattattgtccggtagaggaaaaaacgctgctccctgatgtaaacagcaaggaagaacttcccaataccatgccggccctcttagatgtggcaaataacacatatacagtcatagagggagaaatctattaccgggataatgatatcatggtgagatggtcgggaaacgagacgcaacggaatcgtatccttggaatgcatgctatccggcagtcggtcagatacctgattgatattcagacacatgggtgcagtacagatcaacttgttgaggcacaggaaaagctaaataagatttatgatccttatgtaaagaagtatggatatctgtccagccgtgccaacaagttagcattccgggaggacaatgactactatctgttatgcagcctggaaacggaagatgaaaacaagaatataaagaaggcggatatcttttataaacagactattgcgccagtttccatagttaagaaggtggatacagccatggacgcgttgaaagtcagcctggcggaatatgggaaggtacatatcccctatatgctgagtgtctatccggtagaacgggaacggctcctgcaggaattaaaagggcaggtattcttaaacccagtcaaagcggctgatgggaatcctaatcagggatgggaaacggcaagtgagtatttgagcggtccggttcggaataaactaaaggctgcagaagtgtatgcaaaagataatcccgtctatttggcaaatgtagaagccctgaaagcggtgcagccggaagatttgacggcaacggaaatcggcgtaaagttgggaacctcttggattgatcaggaagattatgaggcatttatctatgagacgctgaatacgccggatcagtacagagacgggacttatgcaatcaaggtacagttaaaccgatatactatgtcttacaaggttactaataaatccagcgactattcttctgtggcggcaagccagacatatggaacaaaaaggattgatgcatattccatcatagaggcgttactgaaccagaatgtaattaccgtcaaagataagattgaagttggggacagtgaacggtatgtagtaaatcagaaagaaacaactctggcaagggaaaaggcaaccctcataaaagatgcttttaaggagtggatatggaaagatccgcagcgtagaaaaaaatatgtggatttttacaatcagaacttcaatgataaccgtctgcgggtttatgacggttcttatttatcgttccccggtatgaatccggaaataaatatgcgggaccatcaacggaatgttgtagaccgggcactgcatggaagcactttgctggcccatgcggttggggctggaaaaacctatgaaattgcggctatctgtatggagttgaaacggctgaagctgatgcataaagcaatgattgtcgtaccgaatcatcttgtggggcagatggcggcagaattcctgcacttatatcccagtgccaatctacttgtgacatcgaaagaagattttaaaagtgaaaatagaagaaagctgacatgtaggattgctgcaaataattatgatgccgtgattttgggacactctcaatttgagaggattcccctgtctgcggaaaggcgtgcgaaaattcttgaaaatcaggtggaacgaatttcgggggccattgcggagatgaaggaggagcagggggctaaatgggggataaaagatatggagcgtcaacggaaaaatctggaatcccaaattttaagtctgagaaatgatgcaaaaaaggatgatgttctggattttgaacagttagggatagatgcattgtttgtagatgaagcgcatgtgtttaaaaacctgtctatcttttcaaaaatccgtaatgtggcaggtatttccaccaatggttcccagcgggctatggatatgttccaaaagatccagtatatccaggaactgaccggaggaagaaatgttatccttgcaaccgggacgcctatctccaataccatgtgtgaaatgtatgtcatgcagttgtatctgcagtcacagaaactacatgagaaggggattgaccattttgacagttgggcggccaattttggcgaagttaccacttcgcttgaaatgtcaccagagggcggataccgaatgcggagccggttcaataaattctgtaatctgccggagcttatgaatatgttccgggaggtggctgatatccaattgccttcaatgctgaacctgaatgtacctaagttaaaaggtgggaaatacaaaattgtggagagcgtggcgtctgagagtgttgagtacatgatgcaggaactggctaaacgcgcggaagcaatacgagcagggaatgtagatccaacggtcgataacatgctcaagatcaccaacgaagcaaggttgctcggcaccgatccccggctgattgacccagatgcggaagtagatggtgacggcaaactctttcaggcggcagagaatatttatcaggaatacattggttcccaggagtttaaggggacacaagctgtcttttgcgatattggcacgcccacaggaaacaagaaatttaatgtatatgactttctgaaacaggagctgatcaggaaaggaataccagaagatgaaattgcatttattcatgatgcccatagtgataagcagaaagaggaattatttgcagacatgaggagcggcaggaaacgaatcctcctgggaagcacgtccatgatgggaacaggaaccaatatccaaaaacgccttgtcgcggctcatcacattgattgcccgtggaaaccttcggatgtaggacggattttgcggacattcaaaataaaaaagaatgtggaggtaacagacaatggcaaaatcattatttgaggaactgggcggcaaatacgaaaggcaaggggattatttgataccgtgcttaactgtacccgccgaagaagaacaggcaataggcatctgggggcaacggcatttagattatctaaaacagtaccgtaaagttacatacaccaatcttcttacaagcggcaggctaaacgcctaccttgccgacatcaacagacaggcacaggaacgctttgaaaggctcatagagggtatgaaacaggcacagggcataacggaacagctaaaggcagaaaacgccttagaatggacaggatgcctcaataacataagggcttgtgcgagggagattgtggaaaaggaaattatttttgcataaacagatgattagtggcagggggaaatcctgccgctttttctgctttagtttgtcagcttgacaaataaagggttaaggaatataattagattcagtattatacaaggagttaataaatatgcggcaaggtattcttaaataaactgtcaatttgatagtgggaacaaaaagtagcagtctcgtttcacttttaatatggggcttagttttttgtacccagtttaagaatacttttatcatgtaattttatatgcccgaaaacatataagtgttttggggctattggagttatttacccagtgataggagtatttatcactgggtatttttatgcccttttttgggtgttgataggaggaaaatcacatgaaaataattaacttaggcattctggctcacgttgacgcaggaaagacaacattaacggaaagtttattgtataccagtggtgcaattgcagaactagggagcgtagatgaaggcacaacaaggacagatacaatgaatttggagcgtcaaaggggaatcactatccagacagcagtgacatcttttcagtgggaggatgtaaaagtcaacattatagatacgccaggccatatggattttttggcggaagtataccgttctttatccgtattagacggagcagtattattagtttctgcaaaggatggcatacaggcacagacccgtatactgtttcatgcactacagacaatgaagattccgacaatttttttcatcaataaaattgaccaagaggggattgatttgccaatggtatatcgagaaatgaaagcaaagctttcttcggaaattatagtgaagcaaaaggttgggcagcatccccatataaatgtaacggacaatgacgatatggaacagtgggatgcggtaattatgggaaacgatgaactattagagaaatatatgtcagggaaaccgtttaaaatgtcagaactggaacaggaagaaaacaggagattccaaaacggaacgttatttcccgtttatcacggaagcgctaaaaacaatctggggattcggcagcttatagaagtgattgccagtaaattttattcatcaacgcctgaaggtcaatctgaactatgcgggcaggtttttaagattgaatattcagagaaaaggcggcgttttgtttatgtgcgtatatatagcggaacattgcatttgagggatgttattagaatatctgaaaaagagaaaataaaaatcacagagatgtgtgttccgacaaacggtgaattatattcatccgatacagcctgctctggtgatattgtaattttaccaaatgatgttttgcagctaaacagtattttggggaacggaatactgttgccgcagagaaaatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaaagtgcagatggaagtcatttgtgccatccttgaggaaaaatatcatgtggaggcagaaataaaagagcctactgttatatatatggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggattagagactaattatgatgaaatgcgaatggatattgtgtcctgtttgtgggaacaaaacccgtaataaaattaggaaggacactgttttggagaattatcccctttattgtccaaaatgcagacaagaaagattgattaaagttgacaacttgaagataactgtcatcaaagagccagacgcttaagacgcagagccgatgaaattgtggaacaattcacgaatcatcggctctttttgtttcgtatttgaaagaacaaactcaccaaataaaaaaaacgatattcgggtgggttattttgttataccctaaattaccctctgaatttgtttttaaatttggagggatttttttatgtccttttttcgggcagttatctatctgctcatacgaagcaaaatttatcaatacatagcatatcagagaacggcaggaaaccagttaaaaaaatttctgcctatgcaacggcacttcctgccttgaatgtagaagtacaatctccatacaacagaattaatatttcccataaccgtaaaggtcatagagcctttgcggtttttcttttgtcgatttttgttggaaagtgccatagggctattagtggtgttaggtgtcgttcgccacctctccatctggattttgaacatttcaaaaattcagatgggaggtacttacagtgaaatacgcaccgagaaaggtatatatcaaggaaagcggcagatatgtggaactgtcctatacggatttctgccgccgcagggaatccgaccagacctatatggacaagctgtttatccccattcaaggctgtctgcttgaagtcgtgagggagcaatacacggacttctaccgagataaggaacggtggcgttatctgaaaaaattagatacgaagaacagcctgctttctctggatggatttacggacagcgaggggaagcctttagactttatcgctgatgaagcggcagacattgcggaaaccgttgtcaatgcggttatggtggacaggctgaaagccgccctgcctttgctgtcggatagtgaacaggaattgatacaggcaatcttttttgacggactttctgagcgtgaagtcggggcgaggttcggcataacccagagcgttgtgaacaaacgcaaagccagaatcctaagaaaactaagaaagataatagaaaattaaaatttaaggcgttcagcccccttgttttttcctttgggaaaatgagggggtttttctctgccctctcaatcaattctgattggaggaaaagaagcatggcatataaccacggacgggaggacaggaaatggcgtatctggaaagaagcggaggaaaagctgctgcgtgagtgcggcgttgatgaagcgaccattgagcagatacgcattgcggacagggcagacttcaattccaacaggcggttttaccgatggacgaatgacattgcggaataccttgaggacatggcagacagggagcggcagacggaagtgggtacggttgcggagttactggacgagattgagagcgaaaatctctatcaagtattagtcgcggtggacgggcgtaccttgaaaatcgtcctgctgaaaatgcaggggtattccacaaaggagattgccccgctcgtgcatttgacgactggtgccatctatgcgaggttagaccatctgcggaagaagctacgaaaattttatagcgtctaaaacagcctgccgtcctgcgggctactgggtgagggatggaaatcccctcacttattttttgcaggaggcaagcgggatggcatacagagttaaggcgtacacgcttcgggaggaatccacggaaagcggcacaaggtattttatcagctttaaggacgggcagggcaaatcccacgagttggaagtgtcggaacagttctttatggagtttcggcagatggaacgcaggaacaggaatctcctccaatgggacgagcggcacagggagttttcggaagtatgggacgaaacgctgaacaggcgggcgttgaagctgcctaagagcatagaggaacaaatgattgaggcagaacgggcagaactgctctgtaaggcggttgacggactgccagagatacaaaggcggcgtttcctgctctactacgagtatgagttcaatttttaccaaatcgccgctatggagcattgcaccgcttcggcaatacagaaatctgttgcgattgcaaaggagaaagtaaaggcggaaatgaggaagtatctccaaccgtgaccgacaccgcccgaaaaagaaatctgttttttatttgtgtgggattggcggcattacatactctcactttttcttcgtgggagtaaatctatttttaaggaggtcaacgcctatgtgcaacgaaaacaaaaacaccgcccgaaaggaggaaagccatgcagaagttacagacagtcaacgccgaaacgctcctttatgaaccgcttgagaagccgtcctttgtggtggacagccttatccccacaggcttgtcgctgttctgcggctcacagaagataggaaagagctggctcatgctgaagctatgtttatgcgtgtcgcagggacttcccttgtgggatatgccgacaatggagggcgacgtgctttacctctgccttgaggacacgttctgccgtatacaggacaggctgttccgattgacgaacgaagcgagcaggcggcttcactttgccgtggcaagctgcaagctgtcagacggtcttatcgtgcagcttgaagattatctgaaagattacccaaacagcaggcttattgtcattgacactttgcagaaagtccgtacagcttcaaaagacaatgcctacgcaagcgactatggggacatctcactaatcaaagactttgccgacaggcattcattggcggtcattgtcgtacaccacatccgaaagcagaatgacagcgatgtgttcaacaaggtgtctgggacgacaggcttaacggggagtgcggacgctacctttgttctggaaaaggagaaacgggcatccgacaccgccaagctgtatgtgacgggcagggacacgccctatcaggaatacacgctgcgtttccgtgattgcagttgggaacttgtggagagaaaaacgcaggagcagcttgcgaaagaaacgataccagacgtcctttttcggttggtggattttatgagggataaggaagaatgggcaggcacggcaacggagctgttagccgctatgagggaaacggaaaccatacccacggtgattacgaaatggctcaatgaataccgcaccacatttttaaatgagaaccatatcgtttatcagtacagccgcaaaaaacacggcaggcagatttcgcttgcaaagcgggcgggtgacagcggtgacggtggtgacagcgatattgggataccccctgttactgtcattgacgcttaaagccgtgtaaagctggcgactctgccctgcgggtgacagcggtgacggcggtgacagtgattttaggataccctgccgctgtcatccctgcgggagaacaccccgtaaacgcaaagtgcaggcgtaggatttacccgcccttttcggcgtgtaaaaccacccctgcggtcagaaaaatccttccgatttttccgactgcgtttacagggtgtaacacactacactttgccctgcaaagtcgtgtgccagacgttccctctggactcccttatggcaggtcttacgccctgcttatcctacgctccacgcttcggataaaagaatggcagcatgacggtgacggctcttgcgagggggtattccaaaaacaccgtcatcatcgacatgaccgtcatgcagggaataagggtgacagttgaggcagtcggtagggggtatcccaaaactgctgtcaccgccgtcaccgctgtcacccaaagggcagtttacccgccgaagaaaggaagatgatgaattatgccctatgcaatcctgcgtttccagaaacgcaaagcgggcggcgttgcggcttgcgaacgccacaacgagcgtaaaaaagaagcctataaaagcaatccagatatagatatggaacgctcgaaagataactaccatcttgtgaatccgccgaggtacacctacaagaaagagattaaccgcatggtagccgaagcagggtgcaggacgaggaaagatagcgtgatgatggtggaaacgcttatcacggcttcgccagaatttatgaacagcctgccgcccaaagaacagaaagcgtattttacgatggctctggatttcatttcagagcgtgtcggggagaaaaatatcctctccgcagtcgtccacatggacgagagaacgccgcatatgcacctctgttttgtgccgattacaccagacaataagctgtctgccaaaacaattttaggcaatcaaaagagcctgtccgaatggcagaccgcctaccatgagcggatgtcctcacggtggaatcagcttgaaagaggtcagtcctcaatggaaacgaagcggaaacatgtccccacatggctctataagttgggcggcaggcttgataaacagtatgaggaaattgtgtctgcactgtccgacatcaacgcctttaatgcagggaagaagcgtgacaaggctctggaactgattgcggcatggctcccagacgtggagaaattctcaaaggaaatcagtaagcagagtgcctatatcaatagcctaaaggagcaaatcgggcaggaatcagactatgcggggcgtatgcgtgatgaaaagtatgagcaggaactaaaggtgcagaaagcgaaccagaagatatttgagttgcagagaaccaacgagcagatggggcggctgctctcaaagataccgcccgaagtgttggaagaattgcagaaaaaccataaaagcagagcgaaagaaaggtagatatgtgaatgaagaaacaggattttaaggtgttaaagaccaaagacttgtacccgtttcccgacaatccgtttcatgtggcagaggatgaaacgctgtcagaattagcggaaagcatcaaggaatttggcattgtcacgccgataatcacacgcccgaaagaggacgggaacggctatgaagtgattgcagggcagcggcgtgtccgtgcgtctgaacttgcagggataaataccgtgcctgcgtttgtcctgcccttagaccgtgaccgagccatcatcacccttgtagacagtaatttacagcgtgagaatatcctgccatcagagcgggcgtttgcctacaagatgaaatccgaagccatgaagcggcagggtttccgcacagacttaacctcgtcacaagttgtgacgaagttgcggacggacgacaaggtggcacagggcttcggcgtaggcaggatgaccgtacaaagatttatccgtttgacggaactgataccgccgattttgcggatggtggacgaggggaaaatcgccctcacgcctgcggtggaactgtcctttttgaagaaagacgagcaggaaaacctctttgccacgatggagagcgaagaagcaacgccctcactctcacaggcacagcggatgaaaagcctaagccagagcgggcggcttgacatggatacgatatttgcaattatgacggaggaaaagggaaaccagaaagaaaccttgaaaatcaacacaagcaagctgaaaaagtattttccgaagaacacaacgccgaagcagatggaggaaaccatcattaaacttttggagcgtgaattgcagaggaaacggggcagggacagccgctaatcttctcttttcgggaggtaaatgcagaaaattgaggtatgaagaatgaaagaaatccagtatgagattgtaaaggaaatcgccgtattgtctaagggcgacagcggctacacaaaagaaatcaatcttatctcatggaacggaagagagccgaaatatgacatccgcagcttttccccgaaccgtgagaagtgcggaaagggtatcacgttgaacgctgatgaagcagcagcactccttgaagcattacagaaagaagtaaacagcggggattgatggtatctgattgacagggcggggcgtttccagacgttctcctgccctgtctggaaaggaagatttaagtatgggcgaggataagaaagcagataaaaagagaaagcgtatcgtgccgaaagcaccagttcagatgataatcagccgtgaatatgtcggcacgcagacagtcacagaagcgtttatcccgattatttccgaggatattcggaagaagattgccgagggcgacaccttcgacaatgaggggctgtccgcttagaatgtacgcaatggaacatgaaaacagataggacagatatggaggttttacagtatggcaggaataagaatggagaacaagatttatgaagtcggcatgtactgccgcttgtcaaaagacgatggcacggataacgagagtgcgagcattgcgacacagaaatccatcctcacggattatgtgaaaaagcagggatggcacttagcaaaaacgtatgtggacgacggttactctggtacaaatttccaaagaccaagtttccagaacatgattaaggacattgaaagcggtctgataaactgcgttatcacgaaagatttatctcgtctggggaggaactatcttgattgcggactgtatctggaagtgtttttcccagagcataatgtgaggtatatagcggtcaatgacggcgtggacacgctcaataaatccgctatggacatcacgcctttccgcaacatcctaaacgaaatgtattccgccgatgtgtcggtcaagataaaatcggcgtaccgagcgaggtttcagcaggggaaattcatggggacgacagcaccatacggttacgtcaaagaccccgccgaccacaaccatctgctgatagatgacaaagttgcccatgtggtaagggaaatatttgaccttgcgttagcgggcaacggaatcgccaaaatccgcaagcacatcaacaaacagcatatcttacgccccgccgcttatgcggcggagcagggggcaacaggctatgagaggtattttgaggagaatgaggagaaccgttatatttggagcgagaacagcgtaaggggcattttaagaagcccgatatatgcgggaaaccttgcaggctacaagcggattgccgccaacatgaaaagcaagaaacgcccctctaagctgcccgaagaatgggaagtgataccagacacccatgaggggatagtcacgcaggaggaatttgataccgtacagcagcttattacaagccgcagattaccagaaaacaagggcggctttgagaacatctttgcaggcgttattaagtgtgcggactgcggctatgcgatgcgggctatgagtgccaacaggaggaaacgccccgacatcatcgactgcgtacaatattcctgcaataattatggcagatacggtaatatcatgtgtaccgcacacagcattgaagcgagggacttgttcaacgctgtcctcaccgacatcaaccgatttgcggatatggcagtcaatgatgaaaaggcagtgagggcgattgaaaagcggctcacggaaacagaccagagcaaggcaaaggcactggaaaaggagcaaagaaaactgaacaaacgccttgcagaactggacaggctgttttcctcactctatgaagataaggtgatggagcgtattaccgagcggaattttgagatgatgtcgggaaaataccagaaagaacagcttgaaattgaagcaaggctgaaagaggtaacggaaacgctcagcgacagctatgagaagacgcagggtgtccgtgatttcctctccctaatccgcaactatcaaggcattaaggaactggacgcaaccatcataaacgcacttatagacaagatacttgtttcggaacgtgagaaacttacagacggaatggtgcggcaggaaatcaagatttattataaattcatcggctttgtcggtgaattacatatcacaccgacaaagcggtggactgcgttaaagcctaagaattgtacggtgtgcggtgttgaatatgttccccgctctggcatatcgaagtattgtcctgcttgtgccaagaagatacagagggagaaatcaaacgagagcaaacgcaggagcagggagcgaaacagacaggcatgtattgaactgtccgcaaaaaatgaccgactgatattgagcagagggaagggcgtatcatacgccagggaaatgataatgaagaagtcaatatataccgctatatcacgaaaaagacatttgacagttacctctgggggattgtagaaaataagcagaggtttatcagccagataatgacagacaaaacggttgaaagggaatgtcaggacgtagacgaaaccattttatcctttgcggaaatcaaggcaattgcgtctgggaatcctatgattatggaaaaaaccgaggtagacacggaagtttcgcgtctgcaggtcttgaaggcaagctatgagagccagcgctatgtccatcaggataatttccttttcaaatatccagaattgattaagaagactgagaaccgattgtatgctatggaaaaagatatcaggaaacgtgaccaggcactctgtatggagccggactttttcgttactctgaacggccttagatatgatgaacgtgaggcggcgggcagcgttatcttagagatggcacattcccttgaaagtatggaaagcaggacggtgggcagctataaggggtttgatgtagtggtagaaaaaaagtattctgactgtatcataaagctgagtggggaactgacttattcggcagatatgagcagcagtgcttccggaaatatggtccgtatggagaacctgttggggagtttggaaaagagagttgccgcacataaagaaaaactggaagagtacaaaagaaatatggaggaatctaaaagggagtttaataaagaattcccctatgaatcggagttgaaacaaaaactaatccgccagcaggaaatcaataacgagctggagataaaagatgagggagaagaactggtggtaacagaggaactcccggaaccggcgatgtccagatagaattcattaaaaaagtagaaggagactaaattatgaaatatacagtaaatatttatgaggtatcaacagagaaagataaaaaactgagggcatttgctgcggtaacgttcggtgacagatttaaagtaaccggtatcactatcagggagggaagatcagggaatctttatgtgagtatgccgcagtatccaacgggggaaaaagatgaacagaataagccgatatacagtgatgtgttttttccaaaaactacggatttcagtaccgcattaaggggagaaattctggaggcgtaccaggaacgtatgggagggaaaaacgaagttgacctcacttatggggaggaagattttgactattatgttcaggtagtaaacaacagagatttgtccaataccactaaggcatatgccagacttgtgattggtgatgtatttgtagttaatcagatttctgtcaaacgatcctttgcaggaaataactttgtggctatgccttcccagcgacgcatggttgaaggaaaggcggaatatcaggatatctgctatccagtgacaaaggattttcatgacaggctgcagggagatattatgagccagtttgagcagaatagggaaaaactgcgctctgcaaaggaaaaagcgaggtgacttatggagaagaaaatcaatactacaataggccgtctggaggaattggaagaggaagaatgggatggcgagaacttcctttttgaaacggatgaggaacatcaggtctggctggacaaaaaacacttggttatccaggaacttggcttgcaaatacatagcggtgtctggtatgaaaaatatgaagatgatgaggacgacagctttgaaccggattttgatttttatatgttttttgatgccggtacaaaggagtatctgtacatggaacagggaagttccctaattacctgcattcataattttaccgggttgagctgggaagagattgaaggacgggcgtgtgaggttatccagacagatcgtgatattcaagtcgaagaacagacattaatctatcaataggaggtggtgagcatagaaataaacatggaacatgtaggctggacattgaaaggaagatgccgggaagtggcggtgtcatttgaacacgaatttgccggttcagtcatatatggagaaaccataaaagaagggcgctggttttatactcttccttaccggaaatctggcggtgcaattgaagaaccaaacgcaggcaacattgattacaatggaaaaataattggaaacgaccttggtagtgcggaattgggtgagatattttcaaaatctatatctgaagattacgaaatgctaaagactatccagaatattgtccaacaaatggaattgatagaggatatctccataaataagatggtatcaggagaaatttatggttttgaggatgatggctgccactctcttattatctctgccttatcagaggatataatctattttctgcggcttgatcaggacggcaaagactatatttttgcagatgatgaggatgaaaaggttgaatgctggccattgaattgtctgcaaagtatggcggaatataagccggaggatttcggatatgatgctggaaccttgcggggattatattattatgctgatacagaaatttataatctgccagaaaaacttgtagactatgaaaaaacggagtttgttagcgcaatggagtttgcggagcggttaaaactacagattccagatattatccggccaggagaaaagaaaattcgataatgcgcagaaatgatttagaataagcagatggaatatggaggaataagtggtggataacaaaaaagtaatcaatcaaactagatatgaggcactgatacaggagggattcccagaagggatattgtgcgtatagcagaattaatcaagtatataccagctatcttgcaggcgttaattcaaaaccccctttttatgcaaatagttacaattatgacctgatagacaccagaaggacatgtgccctgcgtctctatggttatacactgggagattatggaaccataatagacagtaatgcatacagatatgtggaattttgggcaggcagcggaatgtaacaataaaatccgctgaaaacagggctgatagtttgtgcttttagattgttcttttactgttgtttgtaactaaaagttaatgcatgtaataaaatggtggtctgtatatttgaagaaccggattgtatactaaattataacaaatgtaactattagtgaatggtgggattaaatgaataccaagagattaggtaggaaaatcagggaaaaacgtaaacagtgtggattgacaagccagcaattggctgatctatgtcatgtacatgacggctatatccgacaattggaaagcgggaaaaaggttcccagtatgccattgttattgagcctgtgtgatgagttggaaacgtcccccaattacctcttggaatatgcagaagcaggcgatgataagcaactattaaatcgcctgtataagcttagtccagaacaaaaaaacacaatgatatgtatgctggacgcttatataacttatgaagaaaagaaaaagggtgaggaggcataatctgtgtctctgtatatttagaatattctcaagtaattggttgatgattattaaagggagcgcgttattgcggctcccttttgcattttgttttgttaatggaacgagccaaagtttgacaaattacgaaataacaagtaacataaaagtctaaataatagcttttttgtggagggttaatttgatagatgagataaaaaaatatgttaaggaaatattaatgatagtcgaatttgaaatatgggaaagaaacagggagaagcacatgattctccagacaagaaatatacagaataacatgacaatgttaccatatgaaagcgacttcctgtgtttaatccacgattattgtaaaatgaatagaatttatataaatgaaataaaaatatatagtaatgtaagactttatgtttttaaaatatatttaaagaataatatggatataatagcctttccagtggaaataacaaaacatgaacttattttaaggcgtgaacagcaagaaccagatggttttcattctgtggtggataaagaaattaagatacgtttatgtgatattaaaataataaaagtgattcatgattgtgatgatgttgatgttggaaatctggaattatcaaaaccaatgtatggatataaggctatacctgaaataaatgggcgtttgaaaacaaaaggctgtgaatatcgactcaatataccatgtatagtaaaagtaagaaatccatatgttacagattttcaggattgctatttacatttttgtacaacaatagagggcgtagcattgtgtccaggcagaacggaatatttagaatccataaaaaactataaaagaggatcattatctgcaataagactttttcaagtgaaagcagagggacattgtgttcaatatagcggtgattggtgggtcacaaataaattaactgtaataaaggaagttactaaagaagacatttattcatattttatgaacaattcttttataaaagcaaaggttatgaaacacttaaagttaaatcatgatttttgggacggttttcttaaatcagaaatccctccatttatcgaatcggaaacggatatgatgtgaaaaaatacaacaatcttttaatgcaataaattaaaataaattttagggtgggtgtccggacaaaatgatgtaaattgttactttggcaaacgccgcatgaacacttcactatgttcatgtggcgttttcttttgtgtatgtatcttacgtaaaaagctcgtattttatttcgttttctcaaaggtaatgcggatgcattctgtacttttggaagacgcagtgactgtatatggtggcaaagcaagttccatactatcagatataggaaaaggtgtacctgatgcgtccatgagaagtacatcgtatttgttctcactccatatctttacacaatccgtacatagatattttgatataagagattcatctggctgggagtcagcctgcatatatatatctgcacgatagctctcggaggtaatgggtgaggttataatcatagttccgttctcggaagaggtgattgtgacactatgatttccctcccaacttccttttggaatagtactaacggatcgtgagtttaagtttattacaccaaatgcagactcatacgagatatacgattggagtttacccgaacaaatccagcattcggatttggaaactggacggtgtacaataagcaatacaaaagtaataataaaaagaatactaacaagagaagcaatacagagccgttttagtttgcgcttttttcggcagcgcgctatagcctgagtgaattgttcccattcttttatatgccgatagtatgcaggttcaagccgggcccaaagttgctcatactgtttgtcttcagtaagatagggtaaaggaaagaattctttacaaacatccagtaaatcagagatatcttcatcacttacatcactttgcgatagaaaaagttgatttgtttcaaagaacgccttctcgacctgggaagaatcgaaattaccttctagtgctgttaaaaattttgaagccagcctcatagtattttcctccgaaatgttatctaaaagtttattttcgtatctataagataacgtttattcatatggatgtctagtaaaactaatctacaaatgttccctgaaatagacaatctttttatatacaaatgaaactgagatataacatgtgtcatattttggtggactgttgcggaggggaaagtggaattatactagaagataacaaaagtagctaatggtaatatgcatatagatggtgaggtgtgatgtggacccaaaagaattcggtgctaagttgagaggtaaaagaaaagaatgcaaattgtcataccaggaattggctgaaaggtgtcatgtaaaccatggatatatcaggcagttggaagctggcaataagcttcccagcgtttcgcttttattcattatatgtgatgttttaggtacatcccccaattatctgtttggatatacggaggataatgctgataaggaattgctggaacgtatatatcaattaacgccagagcaaaagcgggtgatgctttgtattttggacgcttatttaagcttagaaaagatagaaacagaaagttaaagctggacaagaggcatctctgatctttgagatgtctcttgttttgtgtgccaagcatggcactaatcttgctggtgaaagtccagccacgggtttttaccgccaagtgtagcgaatcacaagtcggtatcagtaatgatatagatggaggaagtggtgtagcaaagttcttgagcctacgaacagaaacttgataaggcgattaggtggggaaggctgcaaaccaagccgaagcccaaatggtaaacgtaaaccgaagttgtaaatcaagaggttgtggaatgaaagattagtgtcttaccttgggagaccctacccacatatcgtaagatatggtcgaaaaaggtttggggagggagtcagatgaagtcatagtaggggtaaaagccgaaggactgaaacgatttatagtacgaatcgttattaaaagaatgatgcattagccagaaatcagatggactggaaaagtaggaacgtaaccgaggaatactgtctggatcgagaggggtgatgtgcataaattttgtgataataagaggagtaacaacaatggaattaatagatgtgattacatcaaaggaaaatctaaacagagcttataagaaagtagcagcgaataaaggggcaggtggagttgacggaatgaaagtcggggaacttggtgcatacatcaaaggaaacaaagacgaaattgttcaatcaatcagaaaccgaacctatatgcccaaaccagtacgaagagtttatattccgaaagataatggaaaaatgaggccattggggattccaacggttttagatagagtaatacaacaagcgattgctcagccaattatagatatttatgaagaaatattcagtgaatttagctatggtttcagacctggaagaagttgtcatgatgccataaaacaagcactggagtatctgaacgagggatatgaatgggtgatagacatagatatagagcaattctttgataaagtaaatcatgacaaattaattcaaattcttagagagcaagtgaatgacagtaccacattgcacctgattcggaaatatctgaaagcaggagcaatggaaaaagggctggaaaaagcagcaataagcggagtgccacaaggtggtcccctgtctgttgtgctgtcaaacgtatatcttgataaattagataaggaactggaacaaaggggacttcggtttacgaggtacgcagatgacacaatagtattcactaaaagtgaaaaagcagccaacagagtaatgaaatccataacagaatggatagaaagaaagctgttcctaaaagttaatgttacaaaaacgaaagtagtcagaccaacaagaagtaagtatcttggcttcacttttctcaaacatggaggggaatggaaagtaaaacccacaacaggaaagaaaaagaaactgaaacagaagctaagtgaataccttaaaagaaataaagcgattgcacgaccgctggctgaaacaataaaacgagtgaatgaaatagcgagagggtggattaattatttcagaatcggaatgatgaaacaatttatggaagagtttggagcatggctaaggcacaagatgagggtgattgttctaaaacaatggaaagtgcctaagagaatatacaaaaatctgtgctatttaaaccagaaatataagtgtggatttgaccatgaagccatatataaggtagcaaactcaaggctcggttggtatagacgaagcggaatgaatgttgttaattatataatcagtccggaagtactggaaacaagaataaaggacggagcaggactgctcaatcctttaaactattatctaagaaatgttggaatataggttgtagagccgtatacgagacccgtacgtacggttcaatgagagggaaataacactcgctgttatttctctactctattcgatgggatatggttcgagtaaacgagaaaaaatgtctattaaatcaaaaaatgttgacatagaaaaaggcatgctctataatagcacatatttttatggtaaaccgttgagtggaggagtcgcgctgattatagagagctactggtggtgtgatggcagcattttaaatcaatgtgaatgggcttgcgagatgaaagtgaaaaaatgataggtaataattttaaacgtgtattgcgatgaaaaatcgtagtatggggacactcgataaacggtaaacaggagacaaacatatgaaggatcatacatgttcaataacagagaacattagaagggcacgcgaagaaagaggtctgacccaggaagccctggccgaattggccggaatatcacatagccatctgagtaaggtagaatctggctccaggacaatcggcatgaaaacatatataaaaatactggaagctttagaggttgttcctgttttggtatctgaagcagatgggacggaaaagagcatagaactattgtcacgtttcttatgtatcttaaaggaatgtccggagttggaacttcagttttacttagacacaattgagtcgatgaaaggcagtttaagcaaaatagccctttcaaataatgacaatgatgataaagttgcgtgagtataaatttacggcattagttgaaaatagaatatgttttgtaagagagctgccatctacaggcagttctttttttctggatttatgtcggaaaatctgaaatggcaaattatacgctagaattggatgatattggtctttacagtccgttctcaaacaggaaatcatcatgtaaaatacattcaaacttaaaaaggagtatggtacgaagatggttaacaattttaatattgctcaaaacattcgtactttaagagaagaaagaggatatacaatagagaagcttgcagaacgggcaggggtgtctgcaaatcatatgagtaaagttgaaaacggtttgagaaatttaagtatggaatcctacttgaatgtattggaggcattgaacgtataccctgtattgatagaatcttcagatattggtgacacgaaggaacagtacatattggcctttataaatatcataaaaggctgttcagggagagaagcgagttttttactggagactgctgcttgtattaaagaaaacatgaataaagccggatttacccttcgtgatggaaccgggagatgatagatacaaccatttcataaggtctgtattgagtatgacacttttggcgtttgtgaaatatcgttaagaagatgtaaagaaaatcattgtcccgggaggtatagagaaatgcttacgattgaagagctggatgctttccaacagataaagttggatgaggttgatattgatacgctggtggatttgaatagtgtaaaaatagatacctctttaccatgtgagaagagaatgagaaaaatactggacgaaggagtaaatccctacctgttccgcgtgggggacatgaagataaaggtatcttattcaagtacgggcaggaccttatccgacataattgaaaatttgatagaaaaagcagagtgttgattgagattcgcaaaagagaaaaaaagaaggtgataaatggttagataggtgtggacaactggaatgaatcatggtaaaataaaagcggaatagaactaaacatttaagcaggttcctgctacttatttgatgtatgacccagggttcatgcgctaactaataagtggttaggagctgtttttatgcgtaaaaatcatatctatcgtgcttatgcttatctgcgcttatccgtggaggatggcgatcagattgaaagcgacagcattaaaaatcaaagagtcatagtacagcgttattgtggcggacaacaggaaatccaaatcatcggtgaagcagtcgatgatgggtatactggtacaaactttgctggggttagatagcgatactttttacatctaccatgttgcggcggtcatggttgacaacttgcgtcggctcctgctcggtatcaacctgtccgacaaagctataatggatttcgattttccgggtgttggtttcccggtctaattcatgtatcaaaatacggtcgataaactcatggacgttttcataggtcaattcctgtatgtcgctgtatttcccgacaatctgaataaaccttgatatatccctttttcgctcggtaacggttgcgatctgctgttgtaactcgtctatccttgcggcaagggatttcttttcgtcctcatagccggaagttagaaacacaaaccgttcatctgtcagtctgcctaatgcgttgtcctcatacagcttgcggaaaagcgtgtcaagttcggtcatacgcgcctgtgctttgaaaagttccttttgctgctgcgctaatgcctttctcgcttccatgtcgccgtactcggtagctttacagataaagtcctgttcgtgttccttaacataccgcaaaacccgccgcatatcttccagcactaaatcaagaagtacgtttttgcggatataatgagaggtacactcgctgcctgtccttgccctgttgcgccatgcgccgcaagaataggaaaacttgcgcggctcgatatttacgccctgttggtaatacatcttatgtctgcaaccagcgcaaaacagcaagccggaaaaaatatcaatctccgctgcttttgtcgggcggtggcgggtagcaatccgcttttgcgcaagttcaaaggtttcctcgtcaacaagcggctcatgggtgtttgggaagaaatagcgttgttcttcttcgttcttccgggtctttttcgacttgtaggataccttgtgagttttcgcggttatggtatgccctaaatattcctgccttgctaatatgtcatagagcgttttgtccggccaagtatagggggcgatcattgcccgctgataccgcgcctgtcctgtacgctgatagcgcaacgctccaatcgtcaagactttgttttccgcaagccatttttggatttcgcacatacgcacgccgctaacaaacatagcgaaaacctgtttgacaatcggcgcggtttccgggtcgggtataaggtggtggcggttgttcgggtctgggatatagccgtatggatattccccgttgacgcgctcgcctttttgcgcctgtgcctgtttaactgcgcggattttcttgcttgtgtcgcgggcgtaaaactcgttaaaccagttccgcaagggggtaaactcgttatcctcccgcgctgtgtcaactccgtcgttgatcgcgatatagcgtactccgttttcgggaaatacaatctctatgagttcgcccgttttcagatagtttctgccaagacgggaaaggtctttggtaatgaccgtcgccactcgtccggcttccacttcctgcaacatcgcttgcagcccctcgcgctcaaaactcacgccggaaaatccgtcgtccacaaaaaactttgtgttcaaaaaatggtgttcgtccgcatagcgttgaagtatcattttttggtgctgtatgcttccgctttctccggcttgcatatcctcttgacttaaacggcagtaaagggcggtgattttattcgactgtaacattagtcctcctttccgacagccgaataaacaggtataatgtgttgctatcattataccatatcccgccgcctaatgcactactcggacgctaaaaatcccggatttccgggctttttctgcaaatcctttacaatgagtttctcaatctttttatggattgtatcggttgccttttcactcggcaacgcttgaacaagataggtgattttccctattttgcgttcggttgtaattgtctgttttttatccattagaaaaacctccttttcctgtatggataaactatattcgtcaaaaggcaaaaacgggcggttgttagctgcaacctcacgggagtttcaccccggcccatgcttatgggtgcgccgcgcaatactttgagggtgttcaacgcgggagtatcattgtgccgccttgtatgtcgtcgcccacaagctgctaaacctgttttacggcgcggtagttctcgctcggcttttcccctatggggaaaagctgtcatggcgtacccgccgactggctcggtacagacggaatgtacccgtttgcctgttatgctgcgcaccaaaggccgctttctttgtcaaagaacaataggctttgtcggcctgcaaaagcacatcaacagcggatatgcttttgcggaacgacaaatagcccataacgggaagcgtggaaaggggacacgctccccgcatgggctaaaagattatcctacatgaaaagcaagggtgcgggtaataaggcgcacttgcagcctgttacgcatttcctcgtccacataggaataggtattgcccgcgtcgtctttcagcgtgcgggtacaaagtttcgctatgtaaccctcgtagtgcttcaagatcgcgcacatggcggttgtgtcgccgtttgccgctgcggaaatgacagggaacggcaacagattttcagacttcctaacggtattcatcatctgcttttccctccaaatactgtttgattttcgcaagcgcggatttcctgtgccggaaaaccgtcgtgcgtacaacattcagcagttcgccaatttccgcgtcgctcatatccaagaagtaggacaaaaggataatgtcgcgtttcctttcgggcaaagcgttaagggcttcggcaagcagttcatttttgacgagtacatcaaagccggacacttgaaaacggaaataatcgctttcgtattcgtccgttgtgaaaagctgcgcgagttcgctttcgctcaaatccgaaaaagtaacttcgcgtgctgcgcgtttcgcaagagtgcggcggtggcttttcgcttcgccgaccaaagttttctttgctaatgcgtcgtactgatgttgtattctttccttgtcggaagaagatagctccatagagttcacctccttcccgcgtggagtagaggacgggagttaagggcttgtcctctctgcccctttcgctccgtacccgttcgggagatggctcttgagtgcgcttttcagaaaaaagttgaaaaaagcaaaatgcgcccgtccgcaagacgcggacgggcgcaaaggaaatgtaagcagtagctaaatgtattgacagttcacattcatagccggaatatcccgcttgcggagcatagctttttttgaccgcaaagcattaggcgggttacagtaaataaaaatggacacggcgatacctccccgataccgccgtatccttaaaaaagggcgactttaatacactacccgcaatccattctataatagggaacagcggcttttgcgcaatattaaataaaaaagccgataacacataggttttttgacctaatgcgttatcggctctgcgtctatgcgtctggcacttttaatcatttttttttgaatttattatatgtgttagctaactgtccacaagccgcgttaatctctctgccatgagaaactctcatagtaacttcaagtcctgcttgctctaattgatgtttgaatgcaactatttcccgtttctgtggtgctttaattcttgaattgcttgttgggttgtattgtaacacgttaatcataacttttttgccccgaaaccattttgcaagttgtcttacatctgagggccggtcatttatacccggtaaaagcaaatacgcaaagacaattttgcgattatgcctttcagaataggataaggcttgcttaacaacatcttcaatagcatatatgcgcatgtgaggaataatacgatttcttgcagattgtgttgctgcgtgtaaagatattgtcaactgaattttaagatgttcctcgcgcaatttttttaattgatcgaccggaccaactgttgatatggtaatgccgtcggttggaaagttgagcccatatctatctcggagaatatggattgcttttatcaagttgtcataattgaataaaggctctcccatacccataaaaacgatacggtttacttttcgacgcaacaatataatctgttgtacgatttctgacgatgttagattacgaacaaagccatttcgcccggactcacaaaaaatacaaccaacaggacaaccgacttgtgtgctcacgcaaacagttccaccatctcgccgcttgataaaaaccgtttcaatgtatttgttgtctttcagttcgtaaacatacttttcagtatcactgcttttgcaaatattttttaccaacattgatagattttttttgcgtggtaattgcttatataattcttcatataaggcttttgcttcattctcgccaataacttccgacatttctttgtaagtaaatccgtatggatcattccgtacttccgcaggcgtatatttaggtaaacgtttcatttttatatcctttcttctaaataataaaagtttgtttttctgtatttttgattacaatctctaatttttctacatcaatgatatgcgtcaatttgcatttagggcagaaaagaggaaaatcttttaatacagtattatgaaatacttgaactctcgtctttccgttacaaatcggacattttatccaatattttttaagcattatatttcactcgtcctttttacacaaaaaaatgtaggtcaatcctcaacatgagcattgacctgcatttataatgcacagagcagtacaacaaaactaaggcatagcttgcactatgtctatactatatctatacgtcgttagttttttgtatagcatccgcaaaataagcatgacaaaaaagcccatgttgaaaatgggaaaatcctttttttcaatgcttatctaatacgcatgctatgcaacataaacgccgcctccttttacataaattttattttatcagaaaatcagtctactgtcaatacacaacaggaagtatttaacctaatgatatgaattgtgtggacatatccaaaaagaaaggtgaactgtaaaatgtaacagggtgaatgaaaatggcaaaaagacccgtaccattgtacgactttaaggctttcggggcagctataaaagccgcgagaaatgaatacggcgagagccgcaaaaaggtaagcgacgagttatatatttccccgcgctaccttgcgaatatcgagaacaagggacaacagccgagtttacaggtattctatgaccttgtaacccggtatcatatttcggtagatcaatttttcttcccgaacagcaatgcggagaaatccaccgggcggcggcagcttgacgcgctgctggacggtatgagcgataaaggcatacggattgtaaccgcaacagcaagggagataacggaagtcgaaaaagcagaggattaacctcacaatatgagaaatcgggagattgcagcgcatggcggctgcaatctttttttgcgtccaaaatcaaaggaacgcgcaacaaataccgcctttcggtgggggtatggagtagatagcaagcacagcaaacgagtacccgtttgcggaaaatgcttgttgggataatcccaaacccttataccgaaaggcggtgcggaaatggaaaaccgaaagagaaatatacagatgaagttttacgttacggaagaagaaaagcggctgatcgacgagaagatgaagcagcttcccataaagcagtatggggcatacttccgtaaaatggcgatagacgggtatattcttgtcgttgaccgaagcgacacaaaagcatatatccgggaactgcaagcggtgagccggaacatcaaccaaattgcaaaacgcgccaatgcgacggggacggtttacaggcaggatatagaggacattaaaaaggcggtggacgagatatggcggttacaaagacgcaccctattaaatcaaccttaaaggctgcgatagactatatcttaaatcccgaaaagacagacgggaagctgcttgcgtcctctttcggctgcgggctggaaaccgccgatattgagtttgcatggacgcgggaagctgccggagatcgcggcacacatttagggcggcacttgatacaatcctttgcggtgggagaaaccacaccggaagaagcgcacaaaatcggcatggaacttgccggggcggtattaggcggcaagtatgagtttgttttgacaactcacgtcgataaagaccatctgcataatcacttgattttcaacgcggttagcttcgttgactacaaaaagtaccattccaacaagcaaagctatcactttatccggcgcaccagcgacaggatatgtaaagagcatgggctatccgtcgtcgtaccgggacaggacaagggaaaaagctatgcagaatacaccgccgaaaagcaagggacaagctacaaagcaaagctgaaaacggcgatagatactctcattccccaagtgaaagattttgacgaactgctgcgccgcttgcaggaaatggggtatgaaatcaaacagggcaaatacatttcctttcgcgctgccggacaggaacggtttacccgcacaaagacgctcggcgcggcctatacggaagaagcgataaaggagcgtatcaagggcgtgtatgttgccaaaacaaaaacgctgcgggaagataagaaaatccggcttgtcgtcgatcttgaaaacagtatcaaagcccaacagtcggcgggctatgaacggtgggcaaaaatccataatctgaaacaggctgctaaaagcatgaacttcctaaccgaaaacaagattgagtattatagcgaacttgaaagcaagatagccgatattatgaccgctcatgacgcggcggcaaaggcggttaaggaagtggaacagcgtatgtctgatttgtcgctgcttatcaagcacaccaccacataccgacagttaaaaccgatttacgatgaataccgaaaatcgccggacaaggaaaagtatctgcgggggcatgaaagcgaaattatcctgtttgaagctgcggcaagggcattaaaggaaatgcagataaagaagctgcccgatctcgccgcgctgcgcaaggagtatagaagcttaaacgacaggaaaaccaaattgtatgaagattatcggcaagccaagaagcaaatgcaggaatacggcgttgtcaaaaagaacgtcgatagtattctttacccgtcccaaagcagggcgcgggagcaggagcgataaggcgcaaaacatggggtggcaagtggaatgttaagggctgaaaacgcctgtgtttctgcggcttccagcgcatgaaaacgacatagacgataaagtatattcaaacccgcaaaaacggctttctaattgtccacgcaaggacaaaaaaagaacaggggcgcggtgccggaaatcggcaaccgcgcccctgttctctatgggctattcctcgtcggtcaagataaactccctttcggaaaactcgctgtccgtcatggcttgcagcttgttcaccgctgcggcggcaagctggcgcatatcctcgtccatgtagggcatggcggcaaggatattttcaagcgttgtttcccggctgtcctcggcgtagatcgcaacaatgttttcttcctcaatggtaaagcgggtattcatgctatcaaacctccaaatcctttttatgctctttctgtttatctttcggctgctgcgccgcctgtttcttgtattcgtccagcttcttcaaaatggacggttttttctgcggctgttcccgtttctcggcttttaccgcttttgcaaggtcggtaacggaaatcgcttcccccgcctttgcccgctgctcaaaatctgcaacggtgggcgtttgcggcgtattgttgataagcccgtcaaaattgttgtcgttctgctctatggtgtcctcgacgtgctttaagggattatcccgctgcggctgctcggcggctatggcataagcctgtgtgccattccccataatgagatacttcccgtcctccgacgcatggtgaaaaccaaatcccgccgcttcgatctgttcacggctcatatcggtaatatgaaaattgcccctcggcgttctaacggtttcacccgtcaaaaggctgtcgggggtcgcttccggctgctgcttttcaagctgcccgtccttgtaggaatatccttgcgccgcgattgcttcaagggtcttgcccgtaacgtcgccataaatccgcttgtctgcgtcaaccagcatttgcaaagtgtcttgtacggtgtcggacaaggcttgctgctgttcgggcggcagcttgtcaaatacgggggtctgctgctcctgcaaaaactccggcacttgctgaaaaccgatactgtctacatagtgggcggtgtcctcgtcgttctgatgaagcacaacaatgtcggaaacggaaaggctatgccccttaaagtcggcggggtggtcgatattaaacctttcccaaatgtcgcccagcgtcatatcctttgtaagcggtgcagtatagacgagttcataatttacccggtcaatggtaagtccagccgcttgcagacggtcataaggctcaaagcgcaagtcccttgtttcgtccccgcgctttaactgataaatggaaaaggtatcgccctgctcctgctcggcttgccgctgctgctgcaactcggtaaaatgcccctcaatctcggtaatgagttcctttgcggtggtctgtattgtttcaagggacgcttttaactcggtcatttccttgccgctgctccaaccagccacatagccgaaagagtaatcggaagtatcaaggccgaaatgctggcaaaccgtataagcgacgctttccgcttctacctcgcaggtatggcggtcaacgcggttttgctgctccggcggggcgtttaagtctacgtcgtgcagcttcgcatgggcgatttcgtgaatggcggtctttaccgcctgtaattcactcacgccctctttgattgcaatacgcttgtcggtcaaactgaaatacccatttgcgccgtttgtgatctgctcaaatgcaatcgggacgggggacgctttttcaagggcggcgaaaaaatcctcgtactgctccacatcggcaagcagcggtttaacggaaaggtcgggaaactccttgccctcggtctgcgaaatatcaaagacggttataaccttaaaggcggggacggtgatttccttttcttcctttaccacttttccctcgcggtcaagcatgggctttctcgtttcggggtcgattttatcaaccagctttttcaccttgtagggcgcgggggcaaagattttaatgcctttctcgcctttctttacatggcggtcaaactccttttcccattgacggaagcccattaccaaattgccgccctgcatagcaattaggatagtgttattcaaactataatcatggaactttgacatagcggttagaaactctttgtagcggtcgctgtcaaaaatcgcctgtacgccctgttccaaacgcgcggtgatctcctttaccttttcggcgggcttttcggaagtaaggataatggggacgacggggcggggctgctgcggctctgcggcctgtgcgtctgcttgctgcgtttcggctgcgtccatataggctttgtcctgttcgccgcgctccggctgcgggtaactcataatgcggtattcttccggcacttcgcgcccctcaaactgccgttcccactcgtcgccgctttccacgatatagccgtactcggtaaacgcgcctttttcctgcgcggcagcgttcctgccaaaagtagaaaggtcaatgccgcctttccattcttcgggcatttgtaccatgccggattgatttaagtaatagtcgcccaaatcgtggtagttatgtacttcggggatatggacgtaaaaatccacgttgtaggtgaagtcaattacctgtccaatatttgcaagcccgtttttctgctgcaaagctgcgttcagcttgccaacctcggcggggtcaagctgttcgagccgcgccgcaagaaaattgagttcgtccacgtcggcggcgcataccatttcataaggcaaggcaatatgtttctccgggtcgtcggaatagccgcgaatggaaaaatcctgcgggttgtcggcggtaatgccgacgttccgcatagcttcgtgcaactgctcctttgtggcgggcatatccaaccaatagccgccggggtcgcccgcgtcaaagcggctgcggttgcctatcataatagaaaactgttcgctcatgtgttcacgctccttttcctgcccggtattttcggggatagctgccgcctgttgctgctgcgggggttcttcgccctctatggtgtagtccggcatgagcataccgtttactttgaaatagtcggcgtactcctgcgggataggcggggagatttccgtaaacaagcggtcatacgctttgatacgcccattcagatacttttccatagctgccttgtcggtgaaaacctttctatcttgtccggcaatcttcgcttgggttctgcttgggctgttggtgcgcacgctccatgtaagcgtccatgaatacgggatagatttctgcgcttctttgtcgtagcgggtattctcgtaaatgtagtaattcatctgatatacccggttgctgcgaatatggcggttatgctcggtggtctgccactcgttagcggtgtgctggacgtgcggcgttctcacatattcaagtgttttatccagcaaaagcgttcttcccgcctgttcttcccatgcggcggcgcgttctttaaggtcgtcaaaaatcgcctgttctgccgccgcgctttcgctgcgcatggaaagtagctgcgcaatcggcaaggaagcataaggggcaatctccctgtcctttgcttcaaaatatatccggcgttctatccgcatggtttcggcggcttctaatttgtcatggtcgtatgaggaatacggcatattctttcatcacgtcctttctcggtcatataagggtttgggactatcccaacaagcaaaatgcccgcgctctctatgggaagcgcgggcatttctcgcaaacgggtactcgtttgctgtgcttgctatctactccatacccccaccgaaaggcggtatttgttgcgcgttcctttgattttggacgcaaaaaaagattgcagccgccatgcgctgcaatctcccgatttctcatattgtgaggttaatcctctgctttttcgacttccgttatctcccttgctgttgcggttacaatccgtatgcctttatcgctcataccgtccagcagcgcgtcaagctgccgccgcccggtggatttctccgcattgctgttcgggaagaaaaattgatctaccgaaatatgataccgggttacaaggtcatagaatacctgtaaactcggctgttgtcccttgttctcgatattcgcaaggtagcgcggggaaatatataactcgtcgcttacctttttgcggctctcgccgtattcatttctcgcggcttttatagctgccccgaaagccttaaagtcgtacaatggtacgggtctttttgccattttcattcaccctgttacattttacagttcacctttctttttggatatgtccacacaattcatatcattaggttaaatacttcctgttgtgtattgacagtagactgattttctgataaaataaaatttatgtaaaaggaggcggcgtttatgttgcatagcatgcgtattagataagcattgaaaaaaaggattttcccattttcaacatgggcttttttgtcatgcttattttgcggatgctatacaaaaaactaacgacgtatagatatagtatagacatagtgcaagctatgccttagttttgttgtactgctctgtgcattataaatgcaggtcaatgctcatgttgaggattgacctacatttttttgtgtaaaaaggacgagtgaaatataatgcttaaaaaatattggataaaatgtccgatttgtaacggaaagacgagagttcaagtatttcataatactgtattaaaagattttcctcttttctgccctaaatgcaaattgacgcatatcattgatgtagaaaaattagagattgtaatcaaaaatacagaaaaacaaacttttattatttagaagaaaggatataaaaatgaaacgtttacctaaatatacgcctgcggaagtacggaatgatccatacggatttacttacaaagaaatgtcggaagttattggcgagaatgaagcaaaagccttatatgaagaattatataagcaattaccacgcaaaaaaaatctatcaatgttggtaaaaaatatttgcaaaagcagtgatactgaaaagtatgtttacgaactgaaagacaacaaatacattgaaacggtttttatcaagcggcgagatggtggaactgtttgcgtgagcacacaagtcggttgtcctgttggttgtattttttgtgagtccgggcgaaatggctttgttcgtaatctaacatcgtcagaaatcgtacaacagattatattgttgcgtcgaaaagtaaaccgtatcgtttttatgggtatgggagagcctttattcaattatgacaacttgataaaagcaatccatattctccgagatagatatgggctcaactttccaaccgacggcattaccatatcaacagttggtccggtcgatcaattaaaaaaattgcgcgaggaacatcttaaaattcagttgacaatatctttacacgcagcaacacaatctgcaagaaatcgtattattcctcacatgcgcatatatgctattgaagatgttgttaagcaagccttatcctattctgaaaggcataatcgcaaaattgtctttgcgtatttgcttttaccgggtataaatgaccggccctcagatgtaagacaacttgcaaaatggtttcggggcaaaaaagttatgattaacgtgttacaatacaacccaacaagcaattcaagaattaaagcaccacagaaacgggaaatagttgcattcaaacatcaattagagcaagcaggacttgaagttactatgagagtttctcatggcagagagattaacgcggcttgtggacagttagctaacacatataataaattcaaaaaaaaatgattaaaagtgccagacgcatagacgcagagccgataacgcattaggtcaaaaaacctatgtgttatcggcttttttatttaatattgcgcaaaagccgctgttccctattatagaatggattgcgggtagtgtattaaagtcgcccttttttaaggatacggcggtatcggggaggtatcgccgtgtccatttttatttactgtaacccgcctaatgctttgcggtcaaaaaaagctatgctccgcaagcgggatattccggctatgaatgtgaactgtcaatacatttagctactgcttacatttcctttgcgcccgtccgcgtcttgcggacgggcgcattttgcttttttcaacttttttctgaaaagcgcactcaagagccatctcccgaacgggtacggagcgaaaggggcagagaggacaagcccttaactcccgtcctctactccacgcgggaaggaggtgaactctatggagctatcttcgcgccggggttatcgttgccgtacccctccatgaggttaatgccgccccaaatgccaagtcctgcgccaagcgcgattaccaaagtctgcaatacgtcaactgcgctgttgaaaaaatccatataaacctcgctttctgccgctaaaacggctcaaaaaatgttgttggaaataaaaatgccgccgtttttattcggcggctgcgtcctcgtcggacaaatctatttcgtatatgtcaaagggttcgtcgggctttacgattgccggacgggtggacatataccgttcaacgtcaaaagcgtttttcttgtcgaagtcggaaaggtatttgtagttcgggtgctgcgttatatcgtacttatcgctgaaaaaggggcgcacgccgcgcaactgcaaaatacattttcctccgtccataactgcgatttcgtcctgtgtcatcaactcctttcccaatttctgataattgaggccatgagaaacctgcgtgccgcgattttcggaagtgttgaaactgtcgattgtttcacgtcccaagttctccgaaatatcctttgcatttttcccgcgccctcccaaaaacaaggtgctgtcggcattgtcaagtatgatttctgccgcgtccttgtaaatggcttttagctggctctgcgattgcagaatgatagaagccgagatttcccggctgcggattgtggcaatcaatttttcaaactgcgggatttgtccaatgtttgcaaactcgtctaacaggcagcgaacatgaaccggcagcttgccgccgtattcgtcgtcggccttgtcgcacaagagattaaataactgcgattgcagcatagcgataacaaaattaaacgtgctgtccgtatcgctcataatcaaaaacaaagctgtttttctgtcgcctaacgtgtcaagttctaattcgtcgtaggacataagatcgcgcaattcctttatatcaaaaggagcgagcctcgcaccgcaagaaatgaggattgattttgcggttttgcccgccgccaatttatattttcggtactgcttcaccgcgaaatggtcggggtcgcgttcttccaagtcggcaaacagcaaatcgacggggctttgatattcctcgtcgtcctcgcgggcttcgctggcgttgataagttccaacagggtaataaagttcatttcctcggcgggggcttcgtaccagatgtagcccaccaacgcgcaatacaaaagccgttctgcctttacccaaaaatcctccgcgcttttttctccctcacctttggtattcgctatcaacgtatttaccagcttcaaaatatctttctcgctgcggatatacacaaaggggttgtagtgcatagattttttgaagttaatcgtattcagtaccttaatgcggtagcccgcccgttgcagcagcttcccgcactcaatcaaaaccgtacctttcgggtcggttaagacgtaagaggaatgaagctgcattagatatgaggtaggcaccctgcgccttgctgactttcatcagtaggtttcagggagccgcctcccaaaccggacgtacacctctcagcgtatccggctttccatgaatcaccttgattctttggtttcgtgtaagagttcaaagcagtcagggcagagagccagagattttcttctcattttcagcattttctgctcaaatatatccctgcctttcagcgatttcagcgttcttacgtggtgcatacataaatagtctgcatgttccccgcaaatctcgcatactccggcctttatgcggtttactatcgtgtgcctgctgtcatatttcctataactcggcataacgtctgccacattgtcatagccgtcgctgtgctttctgaatccatcatggtaaaattcgcagtatttacgtcccttagttgtatcgtatgggattctcagtactccgtttaccatgtgccgcttcttaataacactgacattcgttctgtgctttcctgccagagtttttaacatgctgtaccgcaccatgtagtaatacttgtgcaatgcgcctacgttttctgctatccgatagaagttatataaccctcgaatttcggaattgaaagtagacacaatctctgcatcgctgcggttcatcaggtctttccttggcataggccgccacatttctttgcctgtgtcattgttgcgtttcacctgtatcgctccccgttccatcgcttttttaatccatttttctttcggcatatacaggaatacttttccataccacacccgtttcatgtcgccgtttttacaacgcttcatgttcttggaatggattactttgaaatcgtaccccagatagcgtaccggcttactggaatgggtgactttcgtcttttcctcggacatttccaaatgcagtttttcttggagaaagatttttacatcttccttgattttttctgcgtcctttttggagccgataacgccaattacaaaatcatcggcgtaacggttgtactggattttcttgaagccctcctcaaacggattgtaatagtgctgatccatcttcttccttctggaatccttaaattcttttaccagttcaggagttgatttttctgcgcccattaacgctttacgtgcctttctgtatctccgggacgcccgctcgtattctctggtcgtccttctgcgttctggctcgcaatcatacttttctttgtattcctgcatatagttgtccagttcgctgaggtagatgtttgcacatatcggactgataccgctgccctgcggaacaccggagtaggtgcagttgtactgccattgttccatatatccggctttcaggaacttccagattagaccgataaaagcctcgtctgaaatccttttccgcagtaattcaaccaacacatgatggtcgaagttatcaaagcacgccttaatgtctccctcgacaatccatgtaacacctgtgaagtttttcttcacttgcgtaagtgccgtgtgacagcttctttttggtctgaaaccgtgtgaattgttgctgaatgtcggctcatagattgcttcaagaatcattctgaccacttcctgcactaacttatcatcagtagaagtgattcccaacgggcgaagtttcccgttctttttaggaatgtactttctttttgcaggctttggctgatatgtcctgttgcgtatggattcaataatccggttaattctcggcaggctcatgttgtccagcgtctgcccgtctaccccctgcgtcatgctcccctgcgatttcgcaatgttcgcatatgcaaggagatagaactctggattgtataggttgcgatataatctttcatatttgttgttacttacacttgccttttcttcaaggcttttcaagacatgaatcggatttctcatagtgtctcacacaccatcctttctgttttgaaaatgattcactgttcccctttgccatgtagacggctttcccgtccgcagactactatgggaactctgttgccatggtgaatattcagaaccccgcatttcagcgttttcatagcctttcggcatttcactttaggcaatccccgtttagtacggtataaacaagcgttccacgttgtcggtatgtgacgttcgcctttttccactttcccgtggctgaacctgctccgagtatcagcagccgcatagccaaacaatgcgactgtcaggaacactgacgagtacaacctctctacgtcaggggtacgctcttggtcccgatttcaggctgtcattcaagcagtctagcttccatcctcatacgtggattttcattccgtcacgccggcgcttctgaggcttcagcgccccgtgtcctccgtcatgctatggtcgccctccggtttcccttttggggtaagacggggaatgataggttgcggcacaatgccgcttgatacttttacctactacttgctcaaggtaggatttataccgcccttacgggcgcactaggtttgacaaaaaatcttgtttttccgctgccgctgccgccgatcacgacgacgttcttatttctcgcgtacttcggctgcttcgggcggctgttcatggtaagccgttccgtctgcgtcaaaatgatgttgttttggaaatccgggtctatgtagggctttatatcttcggcgtttccccatcgggcagagccgtactccgcgcccttgcggtatttcttcgcgtttttccctttgacatagactatcaagcggataatcaccgcaccgacaatgccgacaagcaaatccaacgggtaaacgctcggcaaggcgttttcaaaggctgcggaaaatccttgtgtgatattcagtatctttgcagaaatatccgcgccgggggcaagccgcaccgcctgtccgactttatcaaagagatagacaaagaacacataggggatattcggaagtatcagctttttgtagttgatctgcttcatatctcgcgccccctgtccattttctttaccttgtcgcgggcggcgttaagctgcttcgccttgtcctttgcagcggcaagggctttgcggatagagggctttttctcccggttcagcttctttgcggaaaactcttgaaacgctgcggtcataacgtccgcgtcccggcctttgaaaaacacaaggtaacgggtctgctcgcccttaaccttttttagcgaaaaatctatgttgtatttcttcgccgtactctcaaaggctttaatattgctgtcggtgatctcgatgttggaaacacccgcgttctgcttcataagctgccgcatggtctgtttcccatgcgcgggtttgcttttctgctccaaaaacttttggattgctttctgtaacgcctgttcggtaagccgcgccgcgccttttcccactttgacgtatagggcaatcgttttttgggttacttcctcctgcaaggtatcaactcctttcccggtaaagtgcggctatgctcattcgccgccgtataagtcgtgattgacaagggcggtatagtagctgtcaatggtactcggcgcgttgaacagcaccgcttttagatactgcttgatgttgcgcactttggttgtgttctccctcatgcaatccaaaacaaactcaatatggctgctgttcagcttcaaaaacttggatttcaccaattcggcggggtagtcgtccccggcaatacggattgtctttcgggctgtgcagacggtttccagcataaggtcaacaatctcgtccaaacggtctttgtcaattttgcagttttgaatgagatggtcgtattcgatattgtccttgataatctccctgtaaatctctactgcgctattgcttttcgcttccgttcttttcctttccggcggcgtagccgcttcgccatgcgcaaagggcaaggggtttagggaatggaaaggaatggaatcggtacttgataaatcagtaattgattgttctttacttaatatatctttatttaattgcgttggattttccaacgtaggtttttcctgcgtaggtttttccaacgttggattatccaatgttggattttccaatgtaggtaaatccaatataggcggctgtccgccgctggtagctgcttccggctctcgcggctgcggctgctcgtatatgacgtaatctgcgccccgcaagcgtcccttttcgtcgcgctcccggctgcgcacgatatatccggctttttcgagttcctttaccgcttcgcggattgcgtcgatcttctcccggttgatatgggataagcccgcaagggtataatcccaatcttcgggcagcgaaagcatttgcgacaacaagccctttgcctttaaggacaattccttgtttcgcaagtggtggttgctcataacggtatatcccgtatttcgctccactctgaaaactgccatatttcctcacttcctctcttggtatgcgtggacaattagaaagccgttttcggctgttttggtattgcaatatgccctttgccgttttcgcgtctgcaaagccgcatggcacaagggcttttgcccgtctatttgtccatgctggcgtgcgttttccgcgtccttttgccggggcaatagggacactctttgaaaacgcaaaactcatatttccacccggggcggtagaaacggcaagtgccgcaatcttcatcatctccggcacaaccggattgatagcggtcaaatcccggcttctgctgcatgagcaattcaaacgcccgctgcttgccctttgtgaaatacattccggctgcacctcctttcctgcgggcataaaaaaacggcgttactttctcccccaaaggggttaaggtaacgccgtttgtgtgcgtattcagtttttaacacattccctgtctatccgctgtccgcaaaaccattgattttattagctttttgccgctatcgctatcacacctcattattcaatcgccccggtttcaagaaaatcctgaatctgattaaaagtggggagattgactgtattatcgtaaaagatctgagtcgtttgggcagagattttacggaagtattgcggtatgtacagcgtagattcccggagtggggcgtccgttttattgcgattgatgataactatgacagtgaagccgaatcctgcaaagaggattttctaacattacccattaaaagtctgttaaatgaaagctatccggcaaatacaagtatcagtatccgaaatacattaaaggctatgcgtgagcagggactttttgtcggggcatacgcgtattatggctatcaaaaagatccaaatgatcatcacaggttgattcttgaccctatcgcttcggaggtggtgcgggatatctttcgctggaaactctgtggtttaagtcaggatgccatcgcaacacggcttgacagccttggtattttgccgccggcagactataaagtatcacagggggtccggtacaggacaacatttaaaaaatatgaacgtagccattggactgccgtagctgtaggaagaattcttaataataccgcttacctgggaatactgatacaaggaaaaaccactactccgaactttaaagtaaagaaaataatctacaaaagcgaagaggagtgggctgtcgtagagggggcaatgcctccccttgtgagctggattgattttatgattgtcaatcacttgttagagcatgatacgcggacagcgcctggtcaggaaaccgtatatcttttttctgggctactggaatgtatagactgccatcaatcacttgtacgcaaatccacgaaagcaggtggaaaggaatatggatattatgtgtgctctaccaacagggagaatagcaggacatgttcgcctcacagggtttcagaatcaaagttgaaaaaaaacattcttctgctgatacaataccatatttctgttcttactgatttaaaatcaatcttgtcatatgttgatacaataccattttcggaccgcagggtacagaaggaaagctctcggatggaaatgttaaaaaaggattaccagaggaatatgaaattagctgcctcattatacggtgactatcaggacgagctgctgacaagagaggaataccttcagctgaaaaaacagtattcaagccgttgtactgaactggaaaagctgattgagcagcaaaaggtagaaaatgataatatatttcggaatatctgtggtaagaatgcatggattgatcattttttgcaattcggtcaggtaaaggaacttgaccggaggctggtagttagttgtataaagagtattcaagtctccgaaaagggaaatctggaaattacgttctggtttaaagatgaatttagaaaggtcatagcaaaaatcagacagatttgtacagaattgcctaaccagaaaatggaaacattcctggaaagcttaggggaaggcggtgtcatgtgtggctagaaaaagcagaaggaatctggttgaagaacaagttattttctcacttagagaatacagatttggatcttatgcacgcttatcggttagaagcaataaaataaaaaacgatgattccattagtcatcagctgcagagaaacggggaatttataagcaggaatctgtcaggaagtattctgaccggtgaatactgcgataatggtgtttcgggcactacatttaatcgtccgggcttttctgaactgctcaaagatattaagtctggaaaaatcaatgcagtaatcgttaaggattttagcagatttggaagaaactatttggaagcgctggagctgttagatgtagtattcccggaattagatgttcgtttcatcagcatagacgatggatatgacagtgcagatccacaatgcagcaaagaacgaatggtttatgtgattaaacatctggcaaatgaatattacgcccgtatctcttccaaaaaacttacccaggcccatgaactggccagaggcaatggggagttctggggagcgaggccgccatatggatttgagcgttcaaaagccaatagtaaaatactcgtgattgacccggaagctgcctctgttgttgtccgtatatttaacatgtttgtgctggaaggatattcatactataagattgcccaaatattgaatagggagaatattccctcgccgaaagcctatcacttgataaaacatggaaaagcagaaaaggtagaaaagaacccggaaaagtatctgtggctgggcaatttcatttctagtatcattcagaaccccgtttatattggctgtttggttacccataaaacagaacaaagctattataaaggaaaaaaattaaaaagggtgccgcggcaggaatggaatattgaagaggatgctctaccccgtatcataaagcaggcaatttatgacagggcccaaaagaacgcacagaaaatctgggtgaatagctttaccagagaaattgataagaaatatggattattcgcagggaagctcgtatgtggagtttgcggaaggcatatgtcacaaagcaggtatcatacaaagcagggaataggtattgaatatcattgtcctggacatgatgtagcacctaatcattgcaagaacaaatttatcaatgaaaaagcagtattaaaagctgttacggtcctcttagataagtgggtcagtatagcaatgaaggagaaaaaagcatataaaaaggactcttttataaccaaattgaaacgggaataccagaatcagattgctgacattgaccgggaaatccagagccttttagtgaggcagcaacaattatacgaagattatgtagatcagattctggataaaagagagtacatagaatttaaaagacagaatatggagaaggttgatgaactgagggcactaaaagggagtttgattatagagtcaaatgatatggtcaggagatattctttaaagaacaaatggctttctgcattgatggacaagcagggaaatctctgcgtgacagcggagattattgatgaattgatttcggaaatcaaaattatagacaaaacctccatggaagttatcttcaaatttgaagatatattcagcatggatttgattgcaaaggcggtgtgaggatgaagaaaaaatttctgcttttttatgaacgtctttccagggaagatggagacgatgaaagctgcagcattacaaaccaaagaagattgcttaaccgattcaaggaggaacacagtgaatttcatgattatcaagtagaagaatttattgatgatggctacactggcagtaattttaaccgacctaattttcagaatatgatgagcagagtccgttctttatatggaaatatgatagtaatagcaacgaaggatttctccagacttggcagggacaccatagataccgtcaattatttagaaaagatatttccttttttggaagtacgctatattgcgattaatgatgattatgacagcaaagattatcaatatggtatagattttgaagccaaattcaagaatttgattaatgggttagttccaattcaggcgtctaccactcagaagagaattaagatggaggaggctcttcaaggaaagcataacggcccagtacctctttatggatatcggtatacagctgaccgtgaatatgaggtggattgggaggcggcatatgtactacaaataattatggatctattagaccagaaaaaaagttataagtttataattaagttcctggctgaaaaaggaattgatccgccgagcgtttatttggctaaaaaatacaatgccaaattatgtaagaccagttctatctggaataaaacaacactgaaaaagattgcaaggaataaagcttatttgggatattcagtacgtcataaggaagaggcttgtgtattggggacaaaaggaacacgggcagtgaataaggcggaccaaattcttgttccaaacagacagccgaaaattatcagagaagagcagtttaacagggtgaatgagtggctggatgagagggctgctaaaagtggttgcaaaagtggaccgaggcgcagagtatcagcattatataaaaatgtgtattgtgtacattgcggttcagcattaagcaggcgcagatatcatgaagataatgacttttactattgtttggctaagcgtgaaaatccattgtcggattgtacttttccgcctattgaaacagcggtattagaaaaagcagtgttttcggttatacaattcaatttaagattatttactgacagcaaaaagaaaatcttaaaggctttgaatcataatatggcagattaccatgcaatcatggaaagatttcaggagagggcagaagaaataaagcagaagaaaatgaacttgtatgaagattacagagcagggcatgtaagcagagaagaatatctgataaaaaaacagaaattgtcagaacagcttgttccattggaggcaggaattcaaaaggtggaagaaggaatccgaaaatatgatgaggcaaatatcatattctattcagattttgcccgattggtcgatgagtttagaaatgaggaggcgttgtctccggagttggctgatgcctttattgaaaaagtgttggtagacaagaatcataatattgaagttgtttttaaatttcaggacgaaattaatatgctgtgtatgagaaaagcaagttaattactttcaaattaaaaggagtggacaatctatatgaagaatattaaggattgtatgaaaagtcgtatgaaaaagagggccgagttcgtaaaggcaccctatggttatcgtattaaggacaggcagttagttgtagaggaaatggaagcttttcgcgtgaggtctgctttaaagtttgttatggattatctgaacaatccgccggaatacatggtattggagttcatagattataaaaaagatacacagcatcttgtcttgaattacgaggaggcggcaaacagtattccctatagttggatttgccggcaggtgggaaaagaaatagaacttcgggaacaatactttcaggcgggagaagatatatcattgcttgctttacagaatgtgatggagctgtcatttacagaagtggaatcacattggagtaatcaggggaatctaatgagaagtgcaggcatatgggcaaagagattgagaaaaatgcctgcctccgtatactatgcaggggttgttacggcgagaacaaaatcatattcagaagagttgagatatataggcaattatgagccaataatatcaaaggagcaatttgatgcattgaataaacgggtgaatgaaactgtatttgtggactaaatattactgaataaacacctgaaaacatagaaccgataacttatgagcatatttctcatggttatcggtttttttctttctgaactatgttgatgaaaactgtgacttagaagtagtacaggaatgctataaaaagctacatgaattactggcctggggatatccattcacattgatccgcattaataaaagctgtatgcatgtagaatatctggactatatcaatcagatggtgaaaaagctgtcgaaaaacaatttggaaggctttgtagatgtatggaaagaacttatgttaagggaggaaaaactggcaactgcaaatactttgattagataggaaaaataaattaaagaggaatgtgtaggttcaggcaattgtttagtaaaaacaggtctatgcaaaagcgaaaggtgaggtatatggcctgacgactgcccggttctggaaggttaagagaaaatgagtgccttggcacaaaaagaaaatcagggaaggaattcattaaatccttccctggttttcattgatacagaggggtgaaatggggtaatatttataattgccatccggtggcttccacacgtaatttaaggaaattccggtaaattccgtcctttttactgagctggtcatgggtgcccttttgtttgacgtgcccattatcaatcacaataatctggtcagctttttgtacggtactcaatcgatgggctatggaaattaaagttttatttttagtcagctcctcaatcgcagataaaagagcctgttcattttcagggtcaacactggaggttgcttcatctaaaatgacaatgggtgcgtcttttaaaattgcccgtgcaatggagattctttgtttttcgccgccagataatgtagatccactttcgccaattacagtttgatatccatccggcaaggccataataaagtcatgacagcaggctctttttgctgcctccattacttcttcaagtgacgcatcaggcttcccaaacttaatattattttcgattgtgtcatggaatagataaaccttttggaaaaccatactgatacagtcaagcacactgtcagcggtatagtctttcacattttggccgccaatacacacagagccttcctgaacgtcccagaaacgagcgattaagttacataatgtcgttttaccgcttcctgacggacctacaatcgcacatgtagtatgctctggtatgtttaaggatatgtggtcaataattctgcgggaaccatagccaaatgatacatcttttaatgaaatctcataattggaaggatggagtttatctgtggtggtgtccatctggggaatatttgtcacttcttccaaacggtctaattcggtatttattttcttactcaagaatgcactgtttcccatagtttccaaatcagaataaacggtaaatgcacaaaacaaaaatgtcatacagaatggtagggaaatttttccgtccatgtataagataccagcagcagcgattaagacgcagctcatcaatttatagacaaggccatatagccggagaacacctgcggttgccttttcctgtgaataatcagcgtcccatttcttttgaaatgcagtgtgtacctcttgctggccgcttttgccgtttgaaaatgaacggagaacagcaatcccacgtatgtactctaaacatttattaaccagattttcctgggcagcctgataaattggcgaatgttctgcggcccgctgtctgaccaggcgtaatactgtcaggccaattactaagcctatcatacttagtgtccctattattgggttgaaaaagaacatcatgaaagacataaggaatgccatggcaacaccactggtcatctgttcgatagccatcatggagtaaccttccagatccgctatggtagtggttaaaattgtttggatggttccaaggttctgctctgaaaaataacccataggtgcttgttttaatcgctcaccaatttctaaacggtaatcacggaaaatatcataaccggttccgctcatggtacggtcactcatccattggaaaaagaaacgtccaagaatactaataagaatgatagttacagcttttaaaattattgaggaggttagtgtatcaagatttaacatgattaaaaatacactgagcatcataaaactttgaaaaaaggattttaaaatattgcacagtattccaactgttattttttttctgctggagccggcgatttgataaatacgagaaatcatttcaaacatctaagattctcctttcgttttggaagttaccgcatctgaataattctcccacattttcttataaagagggcagttctctaacagttcattttgcgttccgcatccagctattttcccatcagctacaacaaggatttgatcggcattgcggattgtattcagacgatgtgcaacaacaattagggttttcccggaaattaacttactgattgcttcttgtatcagtgcttcattttccgggtctgcataggcagttgcttcatcaagaataaccacggaagcttttttaagcatggcacgcgctatggtgatacgttggcgttctccaccagataggcggtctccggcatctccggccatagtgtcgtagcctttttctaattgcatgataaaatcatggcagtttgcagcttttgcaacggtttctatttgttcgtccgttgcggctggatttcccatgcggatattatcacggatggttttatcaaaaagaaagttatcctgtgcaacataactgatttctcccatcagctgctcaaaggggatgttgcgaatatcctgtgaaccaaaaagcacagtcccggaggtggcatcccaaaatcccgccattaatttggctatggtagatttaccagatccggacggaccgacaatcgctgtcattgatttcggtgacgtcttaaatgagatatcgtgcagcacttcacttttgttataaccaaagcaaacgtgactaaattcaaatgtcggttctgtgagagtaaccgggtccgcaggccgctgcagttcaggagtttttaagaaggcagtaacttgttcaaggtttcctttgatcatacttacctgctccatggcttccgatactttcatcagcggccctgtaaagccaagggggacaataagacatatcatcagaaccggtaaagtaatcgaaccattcataaaaagcaaagcgccgataggaagtgtgccaagtaaggtggagggaaggactgcacgagcggccgcattccatagccagcactcactccaccattccatggtgcagtcgtggaagtaattgacagcttttgagtattgcccataggacgagctggaccggttaaaagctttaatgacctgaataccatttacatattccacaagagaactgttcatttcattcgcagaacacatatagttttccatacgggaggcatatccgcgcatcatggcagcgaaaaacaaacctcccaacgggacagtaattaaagaggccagccccatgcgccaatccaaaataaagattaatagaatactgcatagaggtgctgtgatgtgtgacggaagttcaggcataaaatgggccatagaatcctctagctttgccacattatctacaattaagtttttaaaaatgccggaaggggtttccaacatgacgcccatgggaaccttcgccattttatcggcaattctttcacgtatattttgtaaaatagtaaaggaaatacggtgggacagaagggacgacctccatgtaaggaatgtcttaatgcactggcaaagtgccgcgattcccgccagtatcaccgtatctttagtagtagctgttccggaatagagtgagtctgccaacatagccagtataaggaatggaaccataccaaatagttcccctaaaacggccataagaatggaaaatttcattttccccttgctactgccaacaaacataaaaagctgccggattgcccccggttcttttgatttcatataaacatcttcctttctgctaatcagaatttgtaattgggtattgattttttaggaaaagggtggtaaaatctatattacggtgtaatattacagtgtaatatagtatagaatggaggggaggaaatgtcaagggatttccagcaaactcatgaaaatcttttggcctgtgcaaagaaacacttcttagaatttggctttgaaagagccagtattagggaaatctgtaaagacgcaaatgtaaccaatggtgccttttacaatcattttgctgataaggaagctttatttggttctttagtggaatcagttgttcagacaatccaaaagatatattcagaatcaatagataagcattttgatttagtaaaaacagatgagcttaagaatttgtggaggctgtcagaaagtacgattatccagataatcgaatatatttatgagcattttgatgtattcaggctgcttctgatgtgctcgtcaggaacaaagtatgcaggctttttagacgacttggtacgcgcagatgtgcaggagacaataaaactcattgcagaattaaaagcacgcggtgtacctgtcaatgatttagatgaggacgagtggcatatgttggtccattcttactatgcttcaattgcggaaattgttatgcacaattatccaaagtcagctgcattgaagtatgctcatacgctatcggtatttttcagctcgggctggcaaactgttttggggatttaatccccaaaaaatttcccctacagttagctgaatctaactataaaatatgaaattagtcataacgaaaggacgattaaaatgcaaaaatctaataaactaaatggaaaagatcttatcaatgtaggaatttatactgccatgactcttgtaatattttttgttttcggattactgactgcactgcctgtaatatatccattccttctgtttatctggccgtttgtatgtggcattcctatgatgctgtactacacaaaaattcagaaattcgggatgctgacaattacaggtgtcatctgcggtctgtttttctttcttataggctatacatggattgggctggtggggtggacactgggcggaattcttgctgatattgtgttaaaggccggtcagtataaaaactttaacgttaccctcctaagctatgcgtgtttttgccttggcatgatgggatgccctgcgaatctttggattgccgggcagtcctactgggaaaatattcacagctccatggggaaccaatacgcagaaacattacaatctatgatgccatcatggatgatgtatgcgggatttgtgattttgtttgtcggcgggatttgcggtgctttgctcggtcataaaatgttaaagaagcactttgagagggcgggtattgtttgatgcacatgcttgctgttacagagacgaaaggattccatttagacccacggacaaaattactgctgatggccgttgtagctaccgccgagtttttatatggccataccgcttttatgcttgcagtggctttgataccttttattctattacttacaaacagacaatataaggcagcggccatttttatagttctgtttgtagctgctttggtggttaaggaaatccaaaactcaattcgttttcacatggttgtcaatatgattgtagttttattggtgggattggttttaaggctttttcctgcttttgcaatggggaattacataattaaatctactactgccagtgagtgtattacatcactgagcagaatgcatatcggtaggaatattaccattcctctttctgtattatttcgctttttgcctaccatgcaggaagaatcagcagctattaaagacgctatgagaatgagggaaatccagtttggtacgaaaaaattttggcagaatccaatggcactgcttgaatatcgtttcataccgcttatgatttcggttgtaaagattggtgatgaactgtctgcggcagcgttgacccgtgggctggataatccagcaaagcggtcaagcataacgagagttggatttacctgttacgatgccattgcggtagtaatttcaggcgttatgctgtttgtcaccttatttattattaaatggtagaaggggaagtgaaatgatagaaattaaagatgtgtcctttacctatgaaagcggagaatcagagaatagcctgcgtaatatcaatttgaaaatcgaagatggagagactgttttactatgtggtgaatctggttgcggtaaaacaactttgacgcgcctgattaacggattgattccgcattattataatggacagttaacgggacagatttatttggatgggaaagaggtaaaggattatcagttatatcagattgcccccatggttggctctgtatttcaaaacccgagaacacagttctacaatgtagatacgacaagcgagattgtgtttggatgcgaaaatttggggttgccggtgcaggaaatgctggcaaggcttgagaatacaacaaaatgccttaaattagaaaatctgcttggacggagcctgtttgctttatctggtggagaaaagcagaagatagcctgtgcatcggcagatgctatctgccctaatacttttgttttggatgaaccgtcctcaaatttggatatttcttcgataaaagatttaacagaagtaattcgccaatggcaatctgaaaataagacagtaatcgttgccgaacaccgcctttattacctggctccatatgcggaccgaatcatatatatgaagcgcggagagatatgtaatgaatatacaagagaggaatttttggaactagatccaaaggagttaaagaaaatgggattacgtgcattaaatccatttgacttgatgcctgaaaaaaaacctgaagcaaatgaaaaaagcctgcagattgataacttttggttttcatatgaaaaacggggatatccgattgtaaacataccgaatttaacattgccgcagggagaaatcattggaatcattggtgacaatggagctggtaaatcctcttttgccagatgtctatgcggattagataaatcttcaaagggcactttgaaattaaatggcaatgctctcaatgcgaagaagcgccggcatatttcctatatggtaatgcaggatgtaaatcaccagctttttacagaagatgtacttgatgaacttttgctgagtatggatggagaaaatgaggaagaggacaaggttcgggcacaagaaattttggccgggcttgatttgtcggataaactgaaactgcacccaatgtcgttatccggtggtgaaaagcagcgagtcgctattggcagtgctgttgcatctgggaaagaaataatcatatttgatgaacccaccagtggattggattatagacatatgcttgaggtttcagaaaaattaatacagctaaaagaaatgaaaaaaacgttgtttctgataacgcatgatcctgaactgatatacaaatgctgtacacatcttatgtttattgagcatggccgtatattatggcatcggcctatggataacgaggctgtaagacttttacaggaatttttctcccacgaaaagggtgattcagcaatggctatatgaaagcgaaagagtactttgaagtgggctgagagaaatgttatttgtcataaggactaaagagaacttatttcggatatagaaatacgtaagagtaagctggaagttaatataatgattcaggccgcagtactttttataatagtgacaatgtcgatttatcaaaaagtctgcggcaattattttataatttaatatttaagtaaaacgaaatttaattgaatgtttcataaagtcatctacagccctgtgatgtgacaagcctttgaatgaaacaaactgttaaaatgggctattttaaaaaaatacacatttaaaggggtagaaatattaaaaagaatcctgtaaaatacaatagagttagttgctgctaacatgccgaggctttaactaatagttagtagcaactaaccaaaaccactatattacaggaggatctttatatgagtgaaacaaagggaagtaagtttagtatcagagacgtaatcacggttgcagccatgttggtaatcaattatatgatagcaatggtggtcagcgctgtcacattgccattttcagaagtgtatttatatggttcagccgccattgacggctttttaggagctgtattcttccttgtagcggcaaaccgggtgaacaaacatgggctgttgtttgtttgggcatttgtgtatggccttatccaggcacttatgggttacgccttcttgctgccatatttcctgattgtaggcgttatttccgagctgtctatgattggaaaaaatacatatagaaagccgatccgcaatatgattggctgggctttaaacagtatcgggaatttcgttggatgtgcggtgcctctctggtgggcatgggacagttataaagaaatggcattaaatagtggcttttcacaggaaaccttagatatgcagtttttaatgtcaacccatccggggctgatgcttttgggctgtgcaataaccggtcttcttgctgtattaggtgttctgttcgggcagagactattaagaagacattttcagaaagctggtattttggaatgattatgaatcatagtaacatcagaaaagtggagcagatcgatggcaggacagtgttgctgttggctgtctgcgcatgcttcacttccttcttaagcaccagtttgctggggcatggtttatatatgatatggctttttctattgttatgctattttgagttatttacgatgggattaggaatgttgggggtatatatcctgtcggtagtttggctggctattaatacaaaataccatatctcttttccatcaccgctgttatttcatatgctttatcgtctattgatgccggcgatgattgtgtgtctgatagtgcatataccttcaggcaaactgacttccagtataaggaagttaccgattcccgaaaatataatgctgattataattgtcatgctccggtttgctcccacccttgttcatgagtttggtgaagtaaaagacgctatgaaggtaagaggctttttgcggtctataaggacagtcctttttcacccgcttagtacattggaatatgcaattgtccctatggttttcagaagcctgaaaatagcggacgaactggcatcatcagccattgtcagaggaatcgagagtccgtataagaaagatagctattacattataagtctgactgcaaaagatattttcttagtaatgtccagtaccatcattgctgttgtttgctgcagggtttaaatcagtggggggcggttgggttagtctggattcaggaggtgaggttatgatatacaatgggaaattgattaagaattcggaaggtattagcccccaaagtacaataatgttttgtttcccatatgcaggaggcggtgccgctttctatgctaagtggattcaatattttgacaagaaactttcggtttgccccatacaattaccgggaagagaagaacgtattggtgagaagccatatttgaacatgcaatcacttgtaaaagacgttgtggacgctattatgaggtttgacaatgactttatcctatttggccatagcatgggcggcaaaatagcatttgaagttgaaaaaatgcttgagaacaacaaaagggtagcaaagttggcgattttctccggaagcagagttccccatattccggaaccacagccgatatctcatttgacagaacaggagtttttgattggcctggaacgatatgacggtattccggaagaaataaaaatggataaaagactgttgaacttttatatgccgataatcagatcggattttattctggatgaaagctattatccggatgccccatcaaaattaatatgtccagttttggcaattggcgggaatgaggatagggaagcgaccctggccgatattaagagatggtctgaatacacgcagagcaagtttcagtattaccttttcagaggcgggcatttctttataaaagaagatgaggaaaatgtattaaagttaattcatcaaaaatctgaggagtttatcaatcgtgaaaattaaagtgattcgtcctacattcacttcacggcattgctttatgaataatcttcctccagaagaaatacaggtttggattctgcggtggagaagcatgacaggttggataaaagagaattggggaatcttgaatgaagaagagataaagcaatatacatcatatgtaaagtatgaagacataatgagaggtgcaatagggcgaatcgctgtaaaaaagatttcttcatcttatcttggcaaagatataaaagatatacaaattgagagaggacgttttgggaaaccatatctgtgctgttctggaaaacgtctatctataaattacaacctatctcactcgggagagattgtaatgcttgcctttggacgtaatgttcaggttggcgtagatgtgcaggcaataaaacaaatacaggaatatcaaaggctcgcagaaaattatttttcaccagaagaaacagcaactgtaatcaggcaaaataatattgagtccttttttgaatcttggacagcgaaagaagcctatgtgaaggcaatcggctatgggctttataaagatttcgcctctttttctgtaaaaatcggcggaaccagcagtgaaagctacggagatcagatttggcggatttgtcaaattgctgtagataaatgtcataaagcatgtttggcatatggaatgaggaatgagaatgaactatgggaagaaattgcgaccggtacaggagaaaacgatagatatctggctgggagaaaggtttaaagcaaatagaaataagaccgctattgtggagggcataaatcgtattacctatggagaactggaaaagaaaatcaaccagtatggctgctatttcaaaaggcgcgggataagcaagggtgaactggttgttttgcgaataccgaatgtaaaagagtttgtatttggtttgctggggttaattaaaataggttcaatcccaattgttacaaactctttatttggtgagaatgagttaaagggcatttttgataagacggatgcctcaacattggttttctatgataaggacgaagtatcattaaggattcacaaggggcgtgcaagcagacagatttgtaaaatcgcagtcaaggatatagccgaaggattgaaagaagacaccgaaaatatcatcgaagaaaacaaggagcttgacagcatagccctccttatgttgtcaagcggaacaaccggagttcctaaattagtgccaatcactcatagaatgatttattggcatatttatggatataatcagaaattccagtttacgtcctctgacagttatttagcttgtctgccattagcacataaggttgggttatattcgcccggaattctgaatgtgtttttcgcagggggaaaagctgttttatgcagtgacctggactgcgatgatatttttgtacaagttgaaaaagaaaatattacaattacagccttagttccaacactggcgcgaatctggaatcagtatctgaatcaagagtgtggatatgatttgagcagcgtcaggaaaatcattattggaggttccttggttgatgagagccttgttacaaaattaattgaaaaggtggaatgtgaggtcttacccctttatggagcaacggaaggactggccctgtatagtatttatgatcgcagcaatcttggcgatgcggtaggctaccattattcggtgtctggctatgaggaaatccggattattgatgagaatggcatggacgtactgaatggtgaagaaggagaattgataattcgtggaccatttaccattcaaagttattataaccaggatgtcagtatgaaagataagttcacatcggacggattttatagaacaggcgataaagtgagatgggattccacatatggatatcaggtacagggaaggatcacggaccaaataaataggtctggtgagaaaatagaaccgagagagattgaaatatttataagtgaacatccgaacattgatgaggcggtggtagtaggtgttgaggattttctaatgggagaaagaatttgtgctttcatcatgactgcggatgaaaaaattaatttatcacatatacgaaaatttcttatggaaaaggggttggcaacatataagctaccagaccagcttgtgaagatagatgagtggcctcttacatcggtaaaaaagattaaccgggtaaagctgcgggagattgcgaataacactgcagggaaggagaaaatatgaaatcggagattacatatgcagagctgtgtcagattatagcagagattggggagtattcttatactgcagatatagaaaacataaatttgattgaggctggatttgaatccttaaaggtaatgctaatatccagtgagctaaaacgcagaggtatcaatgtccgcgtttctgaattgctgaaaaaaccgtatctggcggaatggtggaaaataataaaaatgcagagtgtcagcgcagaaagtaaaaaggaagtggataggagtcggacggaaacgatggaatttcctcttaccgatgttcagcatgcgtattgggtgggcagaaatccagatcaggtgatgggaggaatatcgtgctatctgtattttgagtttgaatgtggggaaatagaccggcagaggttatcaaaggcgtgggaaaacgtgcaatacctgcactcatcgctccggacaaagtttttggagagcggaacccaggttattcaggataaaccatataattccagcatcataatatatgacttacaacaattagatgaaacagaaaagaaagagaaaatggaagcggtaagaaatgagtacagtcataaagtgttggctgttgaacgaggcgaagtggcagtactcattttatcggttataggcaagaacaaaactatcttgcattttggcattgatttgctggtagcggatttaaagagcataaagattattttttcggatttagaaaaattatataatgattgttcttttgagaaaacgcaatcgcctttttctcttgaagagcacatgaagcataaagaaaatgaggacgcttaccgaaaagtggccgcttattggaaagaacactttgctacactgccggaagcgccggaactgccattaaagagagcgtatcaatcggtaaagaagccggtgtttaaaagaagaaattttatgctggagaaagcggattgggacaggcttgcggcaagtgctgcgaagaaccaggtcacacctgcaatgatactgctgaccatttatacacagatattagaacgttacagcaatcaatcggattttctgatgaatatacctctgtttaacagaccgtcagaagcagaggacaaagtggctgattttacaaatatccttttgcttccggtaaagggcattgaagaacgaggttttattagtaaaacgaaaagaattcaggaagcctttctggaatcgctggactattctgcttattccggagtgaaagtaataagagatatactaaggtcaaggccaacacaaaagcttgtggcgccaatcgtattttcttgtgactgcatggaaccaatcattactgatgggtttgcagggagttttggcaaattaaaatatatttcttcacagacaccgcaagttttgatagatttccaggtcatgagattcccggaaggcattttgctttcgtgggacacagttgaagatgtattcccgaaaggctttatagaggatatgttcagtgcctatatagaatgtttgagatggactatatccaatcctgacaaatggggggaagaacttcctgtaatatcagagacaaaattcgcagagagatattcaggcataaatacaattggggtaaagcagaatctatgtctgcatgaacttgtttttagaaatgcaacagaccgtagcagcaaaacggctgtcatagaaggcaccggcagaaccttgacttattatgagctgtgcaaagaagcgaagaaattagcacgtttattacagctggaaggtgtagggcctggcgataaggtggctgtgcgattgcccaggggagcagaacagataatatcagtactatcaatattgctgctgggtgcatgttatgtgccgattggaatgaaccagccggataagcgcatcgaaaagatcgtgaaacgcgctgatataagatatatggtatctcatggctgtcatttaaggttaaacagagtgaatatcattgatgtgaatgaccgggcgaagcgggaggagatatctgccaatgaaccagtaaatccttccagcagtgcttatgttattttcacctctggaactactggagaacccaaaggcgtggagatttcccatttttcagccatgaatacaatttgtgatgtgaacaagaaatgtgacatcagtgaaaaagatagtttattggcagtgtcttctttggaatttgatttatcggtttatgatatatttggaattcttggaacgggcgggactatagtcttgctggacgaggcgagtaaaacagatgctgctcaatggttggatttagttaccagataccatataacctgttggaattcagtgccttttctattacggatgcttctggaacaggcacaggctgaggagatgaaattgcaatcccttaaaaccgtattgttgtccggggactggattggtacggacctgccggcaaaattagcagatgttgctccaaattctgaattgacagctcttggtggagcaactgaaggttctatatggtctaattattatcaggtgaagctgcctgttcctaaagagtgggtatcaattccatatggaactcccctggacggacagctatacagggtcgttgaccagaggggaagagactgccctgattgggtgccgggagaattatggattggcggaattggagtggcaaagggctatgtcggtgatgaaaccactacaaataataagtttgtatcatttaaaaacataagatggtataaaaccggtgatatgggaaggttttggaatgatggaacaattgaattcctgggaagaaaagatacgcaggtaaaattcagagggtaccggattgaactgggagagattgaagcagcaatcaacagggcggaaggtattaagagttctgttgcatgtatcgtttcggaaggcggcagtcaaaaactttgtgcgtttattgttaaaaacgacccagatagtgagttgattcaggacgaaaccataaatcagtcgattagttcctatcttcctctctatatggttccatctgaatatcaatatggaaagtctataccgttgagtgcaaatgggaaagttgaccgtaaaatggtagcagaattgttttttaaagaacgtcaggctgtggccggttacgaaaaaccgcagggagctatagaagaagaattagaacggctatggatagaagtactcggttccacaaagtattcaagagatatcagcttttttaaagccggaggcgatagcttaaaggcgattatgctgattgataaaattaaaaagtcacatttagtcaatggagatctcgggacagcaatattagtgaatgcccctacgattagagaactggcaagtcagatacaaatgattaatcagggtgcagagttgacgattgataccatttagctgcagacaaggagaaaaaattatggatatccaaaagtacattaatgagctggcagaaaaagaaattgtaatttggtgtgaaggtgattccatcaagttcaaagctccgaagggggcaatgacagaggaaaataaaaataagttgagacagtataagtcagaagtgctggattatttaaaagcacataataacttagtgttcaccagtgatacaaaacggagatatgaaaaattcccactgaccgacatacaaaattcctatgttatgggaagaaatcgtttatatgaattgggtggaattggttgccacggttacatagaaattgaagtcaatagattacttgatcctggtcagctggaggttgcatggaataaagtgatacaaaagcatgatatgctgcgggcaattgtatcggcatccggttatcagattgtccaggaggcagtaccttcagtggaaatcatagtacttgacgggcgggataaagatattagcgctgataaggaagaactgagaactgagttatctacgaagcagtatcagcttggaacgtggcccatgtgtgatttggccttgagtattgagaaagacaaaagcataatctatttttcgttagacatgcttatttctgactttgcaagtatgaatgtaatgcttaatgatcttgaaaggttttatgagaatcctcatgaaatcattataccgactacgtcttacagagatattgttttatatcaggagaagcggaaaacatttaatagcaaatcaaggcaggaagcggaagtttattggaataagaaaatatcaatgatgggagatgcacctaaccttccggttatagggatggaggacaatcaggaagtgagcttccttcagaagaaagtgttcttgaatgataaacaatggaaagcttttgttgaattggcaaaatcgtataatattacgccatctgtgtttgttatggcagcactggcggaggtaatagcagtttggtctggtgacaaaaagttctgtattaacactacactgctcaacagaccggaagtggctgaagatatatataaagtggttggtgatttcacagatgtcaatattactgccattgatatagagtatagtgaaacatttctggaaagagtgaaaaaactgcaaatggatctctggtctgatttagaacataaagatgtgtccggagtagaaataataagacgtctaacgaaagaacgcaagaaaaatgtaattatgccggttgtgttcacaagtactttgggggttagttcaaaggatgatacaactgtaaaaaacagaattgtatataaactgagtcagactccgcaggtgtatatagactgccaggccgcagaagaaaacggtggtgccactattaactgggacgtgcgaaatggtgtatttgagggctatataatagaagaaatgtttggaagttttgctttgttgcttcaatctatagccgataaaaatagtgaagttcttaaggaaaaatacccggtcagccttatgaaggaaacccttgaaataagacgtgatgtaaataatacttttaaaaatattatgccggcaatgcttgaagatggattcctgaaatcttttaacctttaccctgataaaacggcattaataactgatgagggagaatatacatatcgttcacttgggggatatgtgaatgctgtactgcgtattttgggcgaggcaggaacccaggacggcgataagataggaattgatacaaaaaaacatgtatggcaggtagctgcggtactggctgcccttatttcaggagcgacttatgtgccaatagatgtgcagcagcctgataaacgcaaagagaaaattataagaagtgcagatattaaactgcttttttcagaagcagggaatgaggatttagaacaatactgcaatgttgtagatattcacagcctaaaaccggaaccgacagaatcgttgcctattgataaaatagattatgacaggccggcttatattatatttacatctggaacaaccggtgaacccaaaggggttatcatgactcatcgtgcaacatcaaatacaattgcggatgttaatgaaacatatgcagttggtgagagggatgtattcctggggttgtcaaatttatcatttgacctttctgtatatgatttatttggctgtttttcagcaggaggaacattagtattacccagtacagataaaattagggattccaaatatttgtcggaattaataatcagacatagggtttctgtaataaatgcggttcctgctttgcatcagatgattgtttcctatcttgaatccgcaaatgtcagcgtggattatcaggtgaggctgttattactttctggtgactggattcccgtaaccctgccgcataggatttacgatctgtttggcgattgccgtgtgatcagccttggtggagccacggaagcagcaatctggtcaatcagttacgatatttctaaaaaagcagtatttacaaaaagcattccatatggatatccaatgtccaatcaaacattttatgttctaaacaacgaaatgcagccctgccctaatggggtagacggaagcctgtacattggaggaatcggattatcctccggctacctgaaggatgaacagctgaatcgtgaaaagtaccctgctcttccgtggagtggagagcgcatttacagaaccggggataaggggtgctatttaccagacggagtcattatttttaaaggacgcgaggacggcgataatcaggttaaaatacacggccatagagttgaactggctgaaattagttctgtcttaaatgaacatccactgattgaaagggctgtcgctttagcgttaggtgaaagcccggaggatttgcatattgatgcagtcatttctccggtcaggaaaaagactgtggcatcaccggctctggacgataaagaggaatatttgctcaagtccataaaacaatattatgaagagcagatggatcaggatttacttgaaaagtggattaagaagtcagaggaagttgtttctgcggacatatacaacacgtttagaaagcgcggaattttttcggataaatccaaagccttcaattttgagcaaattgtagaaatgatgtcgataccggagaaactgcacaaattgacaaaaagatggctgcaggtattggttaatgaaggaattatcacatgtgaagccaatgcatataaagcttctgagataagtacggatttaggttctgaaaagctttggaaggaattttttgaaatagaggacgatttccaatacagcaaggagtttgttgattatttgaaggaatcgagtgatttgcttccagaactgattcagggaaaagaggaccctctgaatattctgtttccaaagggagacacagacccggcgctggcagcttatcatgacaataaagtaaatgggatgctcaacaacattgctacgaaagaaatacgttatctgtgcgagaaaaagaataaaaaaagtccggagaaaccctttagaatattagaggtgggagctggagttggtggaacctctctcgatgtgatacccgagcttgaaggctgtaatgttgagtattattttactgatctttcggttttcttcttaaataaggcacaggaaaatttcggtaagtataattgggtgaaatacgggattttcaatattaatgaagacttcgtatcgcaagggtatgaggcattcagctttgatgtgattttatgtgcaaacgtgctccataactcacggaatatcaatagtgtcatgaaaaatttaaagggcttattatcagaggacgcgtccattatcatacttgaggaaacacgaacaagttacctgttgcttacgtcaatggaatttaaggacggcttaaccggttttacggacgaacgcagcgaacatgaccagacattcttcacacgaaaacagtgggaagatatatttaagaggcatgatgggcagctgctttatgaattccctgataagggtagcaaattggacttagctggacagacaatatatgtggttcgctttgccggagaatatgagcagttagaaaaggaggcggtcagaggctatttggaaagtacagtatctccgtacatggttccaaaccagattctgattcttccggatatgccactatctgcaaaccgtaaagtggataccagaaaaatcaaagaatacttcaagagttgggaccataaggagaatatcaagaaaaaggacgagttgccccagacagatctggagcggcgcattgccgaaatatggtgcaaagagctggggattacttctgtggggagaaatgatgatttctatctggtgggcggtgattctctgttaattgctcaaatcattgggaagatgatggagaacatatcggaagcctccggctgggagtggagcaaccttctgacagaaatgatgaaagcacccactattaagcagatagcagaaagccttttgaaccatcaaaatgataagggaaatcttgaggacccgtccttaatgattctgaaaaatagcagtttaaataatgaggattctgttgcgaaggtttttttccatgccggagcgggaaccttaacaccctatacggatttactgtctcgcataaaagaggacagcaaggacagtgaaagcattatcggctttgtttttggaaatgatgcagagtatatttctatggaaaccagccagaccttccggttgttggggaggaaatatggtgagatattggaaaaaatgggatataaaaattatattcttgtgggccattgcgtgggtggtctgattgcactggaaacagcacaatatttgagaaataaaggaatttccgtttctgatgtgacgctgataagcaccggtattccaaagcggaaagagaacacgattttagcggatgcatcggatgagatattccgtaatgcattgcattcaagcctggataacgaactgctgttggagaggatttttgcaagagtgattggggcagatgcatataaggcaggatatcaggtaagcgatgagcggttgcagcagtatatagagtatatttccagatgtggaagtggtgaaattacagtaaaagcattatgcgaaacgggcggggagtatgaagatgtggctgaagagttccgccggctcgccagctatacaatttcagaaaggttaaatgctttataccgcacgattgagcgtccaaatggggagttgatggaacatcagctgaagatgctgaatgtacttttccggatattctcacaaaatttcagatgtgtgtccagttatataccgaagctttactatggaaatataaggattttctgttgtgagattttaggaagccacttttatccgggattttttgaggaagattttgaaacatggaaaccatatatcaaggggaatttaaaatataatacaattgcaggacaacattttgattgtattattggtgataatctggaaaagaatatttctaagattttagattttaactattaacgattgccaaagggtgcccatcaccgtatggacaccctggaaaaggggcggaatatgaagaaagtcgggatattaggcggaactggtgaaataggaaaaagagttgttaaactgttggagaatcaatatgagttgctagtttcctatcattcggtaaaaccatcagttactgcccataaccaatatatccaattagatgtagatatatctgatgacttagaaagcttttgcagtcagtgcagtattatcgtaaattgtgcaggagcctcctttgtcaatggagaaaagattgcaagagcagcggctaaatatcacatacctgttgtggacccttctggtgaggcatttttagaagacagaatagcagatatagagaacgaatcggtttatgtgctttccagtggcttcttcccaggaatgactggcctgttgatgaaatatttatgtgagagcttaaagtcagtagattgtattatggggttgagcatcacgaatgaaattccgagcagatcggcaatcaaagattttattttgacaaatacagccggatttggaactgcattaaactattatgaaaatggtgaattaaaaagggatgaaacaccaatctacaggattgtagaaaataaggagtatacattgcagaactactatacgatagaattgcaacggattactcaaaaatataaacctgagagggcaaactggtattacgcctcttttggagaagaaatcacgaagttaatgcaggaagcagttatcaaatatggtttaaagcaaggcgatgaggcactgcagcaaagtattgattctattatcaagctatttgaaatgactggtggctcaacagcagcatataactatatacatattgaagtaacaggttcagataataatcagggtcacataagaactgcggacgtacatagttcatacagtagtgatatcagttcaattatagccgcttatacggttaaggccctggttgaaaaacaaccggacttcggaattcattatgctatggatatcgtggatttagaaactgtaatacatgatttaccacaattaaatatcgacctggttttgaccgataaaatattggagaaagaggaaacctatgaagaaggatcaatctaagattcatctgcttggtaataaaaacggtaaaagaatacttctcatacatgggatgggattcaattggaagaactgttttgataaggttcttcatatattggggaaagattattattttataattccggagttgccaggccatagtgcttcgtccagtggtgcggttacttctgtcattcttagtgccgactatatcagtactgcattgctgaaaaagggaattaattatgttgatacagtttatggcatttctttgggagcaagtattgcacttgaacttgcactcaaaggtgatataagaataaaaaaactgatactggacggcggacaatatgaatctatgggtaatatgaaatacatatacagccttattatggcgtggcagatgaagcgggttttgcatggaaagcacatgatgaagtatatgcaaaaacaaatggggtatttacataacaatgatgtccaggttcttcagccaatgggggaggccggtataatctttggaacattattacagacagctcttgcagcttacaagtatgatatccggagcaggaaagagaaaatatcaatggaagtggtgattatgtatggaggcaatgaaacatatgcccccaattctgttggtttaataagaagagtcagtatttatcctcttaaagtccgtgcctgtgagaaaatgggacacgcggaggctctgagcaggaaaccgcagataatctgcaatatgatagaagcataatggaggattaaaaccatgccggaaaaacaggaagtgcaggaatggtacggccggaacgccagggttatgcacagtgacagtgattgcttaatagaacggtacgaatgccagggaaagggtttgattgttacatataaagtatttgagggaatggaaatggtattcatggagtttaattccgaagatgcttttattccagtaaccccatacagcgagattctggagattacctgttgccgcagggggagagttgtctgtgaatttgcaaataatatatgtgcccatctgtcggaggaccatttctggattggcagcggggagcatctgccagcttcctattatttccccttcggttactttgatgccgttactctggtgattgacgagaaaaaaatgagtttgtccacgaaaaagattatggcggatttttccatagacattaaggcgattgaggaaaaattatcattgaacactgcatggtatatcagcaatattccttctaaattacagcgattgtttgatgaagtctatgaggcaaaagggaaagagagcacttgctactttgcaattaaaacgttggaacttcttttctatttgcaaaatattgaacgaaatgacgctgagaaggaacagtattatcccaaagaccagatcgaggcagtcaaagaaatctggaactacatgattactcatttagacgaggagcgttcacttaaacaattggtgaaagaaaaaaatatggggactaccatgtttcaaacaatatttaatcacgtttatggagattccccatatgcatttttgaagaaatacaaaatggggattgcgaaaaagctgattttagatggtgaaatgaaaattggtgaaattgccttttcattggggtattccaatgcaagtaagttttctgttgcatttaaagatgtctatggtattttgccaaaagattatagaaagctgagaagctaataagaatatggagaataaaaatgggaaaagaaatagaaatgcagcatgtgacattttcatatcagcataaaattccccagcttactgatatcaatttaaatattaaggcaggggaaacggtggttataaccggtccgtcaggcagtgggaaaagttcgctgacccgagttattaatggactgattccttatttttatgagggcgatttaaaagggaccgtcaatgtagagaaacagcccctttccagttatccatcctgggagagggggaagattataggcaatgtgtttcaggatccacggagccaattttttgccaatgaggtggcaggggagattgcgttcggatgtgagaattacgggtattcgcacgaagaaattgtggcccatgtccaagcttcagccgatagtatgggcataaataatatattaaattataatattcggaacctttcctatggaatgagacagaaggtggcgattgcttctgccgaagcaatcgagcctgaaatttatgttatggatgaaccctccgcaaatttagatacggattcaacagagagattgggtaatacaataaggaaactgaaggaaaagggaaaaacaattctgattgcggaacatagactttattacttgatgccaattgcagacaggtttctgtatataaaagatggccgcgttatgcatgaatttacgcaggctgaaatcaggcagctggccgcggaagaaatccgtaagctgggtttaagaaaccctgacctgcatacggtgacttgttctcatatgccatttgaaaataacagcgatgtgattttagaagtaaaagatttatgtaaaacgtttggcaaattagtggttgcagaccatatcagcttttcctgcaggagaggagaatctatcgctatcataggttccaatgggatggggaaaagtacaatgggaaaaatgctctccggattattaaaagaagattccggccgtgttactctgtttggaaataaaagcaacataaaaaagaggaggggaacggtctggtatattccccaggatctcgacagccagttgtttggtgaggatctgatagacgaactgatactgggcagtaaagaatcaccggaaataagggaaaaggctgggcagatattaactgaactggatttgtatgagtttagagaacaacacccgtccactttgtcaggggggcaaaaacagaggctcgcattggcggtggcgttgatgcatgaagcccccattattatcttagatgaaccaaccagcggccttgacggggtaaatatgagaaaggtaagccatgttattcaggaacttgctgggagaggacgtacaattctggtgattacccatgatgcagaatgtgtgctgtcttgctgccagagagcaatcaggttggaagaggggaaggtgacagacgattttgtgataaattctgccgattatctactggagaaaatggggtattgagctatctgtaagaggataaagttgttgaaatttcgggctattttcgggaagttattttgaaatggagtagagaaccgcggattttttcgttataatacactacagttagtaaaatctaactatagtgcaaatattatggaattggaggagcaacaatgaaacaggaaaagaacaaggaggaaaaaaggaaaacaggaatggcacgttgcctggagctggcatcagaacacaaagggttagtgattatttcaggaattctgtctgcattggcggcagtatgttcgtttataccttatctgtcaatctattttgttatcagggaactgattttggtgtttccggatatgcctgcagcagatatgcctgccattttgatgtgcggctggtttgccctggccggcattgctggaaatgtggtactttatttctgtgctctgatgtgttcccatctggcagcctttggaacattgtatgaactgaaattaaactttgcggatcatatcactgcaatcccgttaggatatcacctgaccattggaagcggccgtatgaggaaaattatggacgagaatatagaaagtatcgaaaaatttatcgcccatcaattcccggattttgttgcatctcttgtggctccgcttattttagtcataattcttttggctgttgactggcgttatggtgttgtctctcttcttggaattgtgctggcctttgccattcaattttcaggattcaatggggcggccaaagagaagatgcaccgttttcagtctgcccaggaagatatgaataatgcatctgtggaatatgtgcgagggatgcctgaaatcaaagcctttaatcagacggcagattcatttaaaagattaagcagatccataactgattacacctccttcatattggaatatgccatggggtggaggaattgcatgccggcgtttacagcgattatccacagcatctatttgttgctgattcctgtaggtatattgattggaagaaatgtgacagattacagaaactactccctaacctttatcttttatttgattttagtgccggccatatctggcatcttaaataagatcatgttcatttcggagtcatttacccagattgacggcaatgtggagcgtatggaagaaattttacatatacctgttttgccggattacagaggcggcgtcaaggagcaggggaaggatattgtctttgatcatgtgagtttttcttatgaagctgaagcagatgtggttgttaaggcgctggataacgtatcgtttcatgccagacagggagaggtgacagcaatcgttggcccgtcaggaggaggaaagagcaccattgctaatttgatttcccgtttttgggacgtgacagagggaaatattcaaattggaggagtagatatccgtgaaattccccttgcggaactgatgaagcaggttggttttgtatttcaggacacatttctttttaaacaaagtgttttggataatattcggatgggaaatcctgatgcaacagaagagcaggttatagaggctgcaaaggcggcccagtgtcacgaattcatcgaaaaattgccgaatgggtatcatacggtaattggttcttcaggaatccgcttgtctggcggggaacggcagaggattgccattgccagggccataattaaggattcccccatcatagtactggatgaggcaactgcatttagcgatccggaaaatgaatatttaatacagaaagcttttgagaaattgattaaagacaaaacagtggttatgattgcccaccgactttccacgattcgtaacgccgaccagattcttgttatagagcagggacatctcattgaacagggaatccatgatggattaatagcaaatggcgaaaaatacacgcagatgtggaacagttatgtagaatcagtcaattggaaaatccatacagggaaggcggtgtaacgaaatgaaatttttacaagaacgactgttattatctgataaaggatattcagaccttaaaaaagcgatttttgcctgcacattgacaaacctgtccattatgctttcatctgcgattccaattctgttgttcggccagcttttaaagccctttatggggcaggagatatcctggtcaactatgtgggtactattggtgatcggagtgcttgctacaatcctggtctttatcgctgccaagaatgattataaaaaaacttaccttgcgtcatataaggaagcaagcaacacgcggttacggattgctgaacatttaagaaggcttcctatgagcttttttaacacaaaagacttgtcagatataactacaaatatgatggctgattgtgccagcatggaatccatgcttagcagtacgattcctccgctcatagcaaatattatatcggttacacttacatgcgtatgtctggccttttttgactggcgcatggcattagcaatattttgtaccatgcctgtctgcttctttataatatggtgcggccgtaaactgcaattacacctgtttgaccagcaggtgggggtgaaactggcggcgtccagtcagattcaggagtatttggagggaatcaagattatcaaatcctgtggcttgagcggagaacgttttcagacactgaataaggctctcctggcaatgaaaaagacggcaattaaagtggaattggcttcaggtattcttgtgcaatgtgcgagcctgattttacaggcaagcctgggaatcactatatttatcggtacagtcctgattacaggtggacagattgaattataccccctcctggttttattgatgttttctacacaaatttatggaccgatattatctatcctatcacagcttaccagtttgttccatctgggaacggttacaaagcggatgcgtatactgctgacaacaccggcaatggagggagaagaacaggacattaaggattatgatatcgagttaaatcaggttacatttgcctatggaaaagaagatgtagtaaaaaatgtttcggcaaaaataaatacaggtagcattactgccctagttggaccgtccggaagcggaaagagtaccctggcaaaactcattgcccgcttttgggatgtagataaaggtactgtgacaatcggcggtaaggacctgaaacaaattgaaccagaatatttaatgcgtagcatgtcatttgtttttcaggatgtgaccttatttaatgacacggtatttaataatattagaattggaaatatgaatgccagtgatgagcaggttgtatcggctgcaaaagcagctcattgtgatgagtttatcagacggctgccggaggggtatgacacgatccttggtgaaaatggcagtaccttgtcaggcggagagaggcagcgtatttccattgcccgcgcactattaaaaaatgctcccattattctgctggacgaggcaaccgcttcccttgacccggagaacgaggtattgattcaacaggccattgccagacttgtagaagggaaaacagttataatgattgcccatcgtctgcggacagtagtagatgccgaccaaatcctggtattgaacgagggggaactgatggaacaggggacacacaaagagcttcttgaacaaaaaggactgtacagcaaattattctacatacagcaggaaagtcttggctggtcagtctaaggtgttacttaaaatatggacagttaaaaagataaggaagtgattctatgttaaataaaaatgatactcggtctatgttgcttcatgacagcccgcaaagtttagtattaaaacttagcgtacctgcgattatcggcatggtggttgttgggctttacaattttatggatggagtttatgtcggacaaatggtaggagataacgctatggcagcggtttctgtgtcctatccatttacgcttgccaatagtgggatttccacgctcatcggtatcggctccgcttcaatcctatccagggcgattggaaaaagggatcagtctacaattgacaagataatgggaaatctgatcgccatgaatttgattttttctcttatcatcatggcgataggcatgatttttacgaaacagattttaatgctttctggtgcaagcggagaaattctggagctggcactccggtatttacgcatcatctttgcaggcagtctgtttgtcaattttgcacagtcctcaaatatgattatgcgtggtgagggattgttgaaacaggcaatgctctttagcgccggttccgctatcatgaatattatacttgacccgattttcattttacttctaaaaccttatggcatgggaattgatggagttgcatatgcaacagtggcttcgcaggttgcgtatgcaatggcttctctttggtattttaagcgaaggagtaagactgtgagaatcaatgcaattcgcattgaaagaacgcttttctcggaaatcatcggagtaggtttttctgcgatgctgatgcaggtgatgatgctggtccagcaaaccgcactttataatcttgcggcgcagcatggaggagatacatggcagattatactcggcgcaacataccgggtagtgtcttttgcatttattcctttatgggggctttcccagggatatcagccggcggtcggaaccaattatggtgcaaaacaatacgaccgggtaaagcacatcacgaaagtgtttgcaatcacagcaactttattagcgcttattttctatttgccgattatgttagtaccgaatacaattctctctatgtttattacaacgccgtccgtagtggaactgggagtaggggatttccgtctgttcttcctgtcatatattttattaggagtctggattgtggttctgaccctgatgcagtctctcggaagagctacaaaagcgagtgttctggttattttacgccagatagccatttacataccagcagccatcatcatgccttatattgccggatttggtgtacatggcgtatttgctgctccgtttattacggatgtgatagtatttattgttgcggttggtatgatgataaatgagtttagaagaatggatgcgttaaaagcttcagggaagtaagaaatctgtttttctaaacagtatcgaaacacaggaggtgatgcagcgctgaaacttcatgaatcaggagagaattatctggaagcggtgttaattctgcaaaagcaaaaaggtatggtacgttcggttgatctcgcccggcacatggggtatgccaaacccagcatcagccatgcagtgacggttctacgtaatggcggttatttgacaacggacactgacggctatcttcatttaaccgttgcgggccgtgaaatagctgaaacaatatttgagcgtcaccaattctttacgaatcagcttattgatgccggaatcgaccctgccattgcggaagaagaggcttgccggctggaacatgcaatcagtgatgagacattccagaaactaaaaagacatctgttaagaaaagaggaagatgaaaacacacattgattagaggtgaacagaacgtatgatacaccaggtttattccatagcagaagaaattaaaaggctgcgcgaggaaagagatatgacacaggaagaattagctgagtcagctgaaatttcgttaagccacttaagcaaagtggagagtggttccagaatgattggtatgaaaacatatagcaaaattttgtacgcgttaaatgcagtccccattatgataacggaaacagaaaagagcgaaatacattccgatttagtgttgcgtctattatcaatattaaaagaatgctcggaagtggaggtggaatttttattgaatactgtagaaacaataaaaaacaatatggatatcataagaaaccacgaaaagagtagtgctgggaatcataagagaaatacacatcataattatccagcatatgaagccagaagaactgtttaaattacaagttgatggggctgttgcaaaatagttgagaaatcagttatggaaccgcagctctccttattcatgcataaaagaagaaaaacggtctccgtacgctttcatatgttaaaatataaactagattcgatgctggctctatgctgggacagtgtggactggttttgtaattttatttccgtatcaacatatcattaccatgaactagtaaaacatagaaaaagtcacatgaaacgtgaaaatatttacgtaatacaaaccatggaggggctgctaaccactaatcaaaatgaaattgtaaaataagagaagtatgcaggaatatccctgattgacactacaaggttaatcagggatatttatattttagtttatgactatcattttaatcgtgtataaaagtttttcgtcaagcaatacaacagccgtatttttcagcatggctcttccaatagaaatacggtgcttttcaccaccggataaagtagaaccaccctcaccaatcatagtatgaaagccttggggctgctccataatgaaattatagcagtttgccaattttgctgcctgttcaatttcttcatgagtggcatttttttccatagcgtatattgtttgcaatcgtatcctgaaataaataaacctcctgaaataccacagaaattttcttcatcaatttttcggggtcaatggactgtcagtcaatggataaaaagagaaaatcatcgtagaataggttcatacacatcaaatgatttagttatgtataactgatgtggttactgaattggataattcaggtttgtaccttgacaatagaatatcagcatggtagatgcattctaactttattatgacataaatgacatgttggaattcatcttttgagatactaaacatttgggacatgcttaaaagcatgaagaagagcaatgagctgcgccacgatatacctgccttgaatataactacaaggtaaatgtcaggaatcgtaatagaagaagtaaaggtatgagcggcactttttcttggaccatataaccagcggtctaaaacccagaatgataatgatacctccgtaataatagaatcacggtccaggtagcgctggaggcatgaacagtgagtaagggtgctgtaaagtgtcaggaaggttgtggttatacctaatctacatgttcccatggtacaaggggtgagataatattcagccgcaccagtttatggtgcggtgtaccattaaaaaaatagaactaatcagcaatagaacttgcttattagctgtgcttttttaagaatattattatattttttttggttcttacttgacacaggcaggaaaatcaacgctgatgaacatcctatacgggctgtaccagcccgatgagggggagctgctgatccgtggggaaccggttaaattcagcaattccaaggattccatcagacataagatcggaatggttcatcagcatttcatgctgatcccaaagctgacggtgacggagaatatcatcgtcggacaggagatcggcacggccttaaaggtggaccggaagaaggccggggagacgatcggtgcgctgtcagagcagtacggactgaagatcgatcccaacaagaaggtggcggatttatccgttacggaacagcagcgtgtggagattttaaaggtgctctaccgggaagcggaaatcctcattttcgatgagccgacggcggtgctcacaccgcaggagatcgatgaattctgcgacatcctgctgaagctgaaggaaaaaggaaagaccataatcttcatcagccataagctggcggaggtgatgaagatatccgaccggatcactgtgatccggctgggaaaagtcgtgggaaccgtggaaaagaaggagactgattcggccgagctgaccagaatgatggtgggccgtgatgtaaaccttggaaggcgcagccgccgccagtttgagaaggcggaaaacatcctggaggtaagggatgtcagctatacggtcgacaaaacaattaagaaactgaaatcaatcaatctggagctgagaaagggcgaggttctcgggattgcaggcgtggatggcaacggccaggaggaactggtaaatgtcatatgcggaaagctgatgcccgacagcggcagcgtcgtgatgaatgggaaagatatcacaaaggacaaaatccgcgacagaaaggaccacggactggggctgatcccggaggacaggcacagggacggtctggttctggaatacagcattgccaacaatctgattctgggcctgcagtaccatgaaacgtttgcgaaaaatggaatctggctgaattttaagaagatccacgacacggcggaggaaatgaaggagcagttcgatatccgctgcgccagcgtcgatgtaaacgccggtacgctgtccggaggcaaccagcagaagatcatcattgcaagggaggcctccagggatccggatgtgctgattgcggtccagcccacccgcggcctggacgtgggtgccatggaattcgttcagaaaacactgctggagcagcgggataagggaaaaggcgtgcttcttttctccctggagctggacgagattctttcggtcagcgacaggattgcggttatcttcaagggggagatcatcgacgttgtggacgcacagagcgtgacgcgtcaggaactgggaatgatgatgctcggatccgtaaaaggaaaaggaggtacagaagttgggacagcaggttaaaacaggaaaacagatgccggcaaagtttcgggaggtaggccttaattttctgatctccttaattgcgctggttctggcaattataacaggcggaattatcatctggctgttcggcaacaatccgatcgaggcgtataaagcgctgattcagggcgccttcggcacaccgatggcatttacccagtctctgacgaaatcggttccgcttctgctcacgggacttgcagtggctctggcctataaatgtacggtattcaacatcggagccgagggacagcttctcgtgggagcgattgcggcgggcattgcgggaaccctgtttccgatgccggggatcttaaatattcccttcgttctgatcgtatccatgctggccggcatggtctgggcgtttttcccggccctcttaaagcagaaggccaatgtcaacgtcgtaatcagtaccattatgttcaactatgtaggccagtatctggtgcagtacttaatcctggggccgtttaaggcggagggcgctgcgtcggccacgagaccgattcaggccacggccatgcttccgaagctgctgccgtcgccctacgtgctgaatctgggcattgtgatcgccctgacagcggccgtggtcgtctacttccttttaaaccgtacctcattgggatatgagatgtgtgcggtgggattaaacaaaaatgcatccctcaccaacggcatcaacgtggagcgcaacatgttcctcgcactgctgatgagcggcgcgttagccggtcttgccggaggaattgaagtaacaggaaccatgggaaaggtcatcaacggtttctctgcaaactacggcttcagcggaatcccggttgccttaatggcgcgcaacaatccgtttgcgatcattctcacggcgcttttaatgggaagcatgcgcagcggatctctgatgatgcagtccagcgtaggtgtctccaaaaacatggtggatatcatccagggactcgtaatcgtattcctgtgtgcggaaaatgtgatccgttattacataaagaaggggcggggaggaaaataatatgctgaatttcttgatttttatgctggcttccacattgcgaatgggaactccgatcgcgcttaccgcccttggcgggctcacctcagaacgctccggtgttgtcaatatcggtctggaaggaatcatgctggcaagcgccttcggtgcggtgctgggaagctatctcacagggaacccgtggatcggcgtgctgactgccatactggtcggtgttttaatctcggcgatacactcggtgatctccattacctggggcggcaaccagtcagtcagttccatggcgctggtgctcctcgcaaccggattttccggtgtgggactgaaggcggtcttcgggcagcagggcagctctccgcaggttccgagcctggagcatacgccgattctttcgtcgattccggtggtgggaggatttttatccgatttgtcccccttcgtgtatatcgcgtttctggcgctgattctgattcactgtatgtttaaatacacccccctcggacttcggatcatcaccgtgggtgagaacccgaaggcagccgagacggccggcttatccgttcacaagatccggtatttctccgtgatcctgtccggtgtgctgggcgggctgggaggcgcgtttctctcactcggacagatgaacttattccaggagggaatggtggcaggccgtggttatctggctctgggagccgttaccatgggacgctggtcgccgatcggggcctttgcctcgtccatgttcttcggactgttcagcgcgatacagctctacgtgcagacaatcccgggaaatccggtgcccagtgagtttatccagatgattccgtatctggccagccttttggttcttgccgtcagcttaaagaagaacagcagcgcggtgggaatcgccgccagcggcaagccatacaccaagttcgtccagcagcggtagctgcctggcagcccgcggtcacaaagcgcgggctgccgaatacggcgcggtcatcagacaaacgctgaccgcgtattcttgtttcataggaaagttcaccctatgaaacaagagccctccgggggatgcgcactccgcgctaaggtaatatggccgctgaagcgaccgcgctccggcgcaagagtccggcaagccggactctttatttggccaatttcaagaaaagttatcaaaaagataaggagaatatgttaaaatgtcacaaaaacccaatatcatatttatacagaatgaccatcaggcatattaccattgggaatgggaaaacggtccggtaccgatgcgtccgaacttcatgaagctggctgccgagggcgcctgtttcactcattcctactgtgcgacaccgctgtgcggcccgacgaggcgtaccatgctgaccggcctgtttgcccatacccacaagcagtatcacaactatacggacccgccatacgatcacgaggtttatctcgatacgctggcggaagcgggatacgacaattactatttcggcaaatggcatgcaggtccgggcgcggcgaatgaacatcactgcagcggattctccagaaccgattacagcaacccttatattcagccggagtataaggaatatttaaagcggtacaacttaccgcaggcgctccatcacatcgaccgttacttcgacattcctgagatcagcagccgcggcgactgggcggaatgcgcagatgatgtggattaccagtgcaaggccaactggtgcggcgagcacgcggtgggaagcacactcactccaaaggaaacccatgagtccttcttcctggccacgctggcctgcgagcagctggaaaagctggcaaagtcggagagtgaccagccattttccttacgagtggatttctggggacctcaccagcctcatttcccgacgcaggaattcctcgatctgtatccgaaggaagactttgttctgccggagtacggcagctaccggaaccgccttcagggaaaaccgggcgcttactaccgggagagaagttcaccattcggaaaagatgaccagttaatcattccaagcgccgtaaactgggatgaatggacggagattatccgccatgcgtttgcacacatcaccatgctggatgcggcaggcggaatgatcgtcgacaagttaaaggagctgggcctggataagaatacgatgattatctggacaacggatcacggcgatgcgctggccagccagggcggccactttgacaagggctcctatatgtccgaggaagtcatgagaatcccctgtgcggtcaaatgggacggcgtgattccggcaggccaggttcgggatgaactgatcagcaccgtcgattatccggttacaattctcgatgcggcaggaaccgcctttacaaagaataaagtccacggcagaagccttctgcctctgcttaccggaaagacggaccagtgggatgacgacctgatggcagagacctttggccacgggtacggagaagatatcaacagcagaatgctggttcacggcgattacaagctcatcgccaataaggaaagcattgcggaactctacaatctgaggacagacccgttcgagttacataatctgtatgaagatccggcctttgccgatgtgagggccgatttggaaaacaggctccgcgtatggcagaaacggaccgatgatccggtggaggtactgtagaaatggatgaaaaaatcacgcagatgctgattgaagaggcggtggaggccagaaaacagtccttctcccccttttccggatttgccgtgggagcggcgcttatgacggcagagggagcggtctaccgaggctgcaatatcgagtgcagcggtctgacggccagcaactgtgcggagcgcaccgcgtttttcaaagcggtcagcgagggagaacggaattttaaggcgatcgccatagtgggcggtcccagtgacagggacgtggaaagcctgtgctatccatgcggaatctgccgccaggtaatggcgcagttctgcgatctggattcgttccggattatcgttgcggcagaccgcacccattgggaggagtgtacgttaagggagcttctcccccgggcgttccggagacactgtatggcggaagggagcgaagaatcatgagaatgtatgatgttattatgaagaaacgggatggaggagtcctgaccgacgaggagattgggtacttcgtaaatgggtatacaaagggagagataccggattaccaggcgtccgccctgctgatggccatctattttcaggggatgaacgagcatgagaccgcttatttgacaggctgtatggcggcatccggcgatgagatcgatctgtcacccattcccggaatcaaggtggataaacactccaccggcggcgtgggagacaagaccaccatggtgatcgggcctgtggctgctgcctgcggcgttcctgtggcgaagctttccggcagaggactgggacacacgggcggtactctggataagctggaggccataccgggcctctcaacgtctctggaccagtcgaaattcttcgatatggtgaaagagatcggtatcgccgtggccggacagacggggaatctggcgccggcggataagaagctgtatgcgctccgggacgtaactgccacggtggataatatttccctgatcgcggccagcatcatgtccaagaagatcgcttccggttccgaccgcattcttctggatgtgaagacgggaagcggcgcatttatgaagacgctggacgattccatcgcgctggccagggagatggtggatatcggcacgaacgtgggacgggaagtcgtcgctctggtcaccgatatggaccgtcctctgggcagaaatatcggtaatgccctggaggtcatggaggcggttgccacactgaagggccatggtcctgaggacttcacgcagatttgtctcgccctgtcgtccaacatgctgtatctggccgggatgggaaccatggaagcgtgcaccgccatggcgaaagaggcgattaagtccggaaaggcattcgaaaaattctgccagatggtggaggctcagggcggagacgcttcctatgtgagaaagcctgagaaatttactgtctcgccggtgcaatatgaactgaaagcagaaaaaagcggctatattaccgccatggatacggagaagatcgggatggcggccgtggagctgggggccggcagaagaaagaaggaagactccatcgattacggtgcaggcattattctgaatgcgaagatcggcgaccgtgtggaaaacggacagacgatcgccacgctgtatacctcggcggtaagcctcttatcgggagccatcagcttgttaaaagaggcggtcgtgatcggaaaagagcagccggaagcggaaaaactgatctatgcgagaattacgaaagacggcgtggaacgatattagagagagaggatagaataactatgacatatgctgagatgcttcattgtgtggaccataccctgttaaaggcctgcgcttcatgggaggagatttgcagactgtgtgacgaggcggtcgaataccagacggcatccgtctgcgtgccgccctgctatatcaagagaatccgtgagacgtatcccgacctgacgatctgtacggttgtaggcttccctctgggatacagcgtgacggcggccaaggtctgtgaagtgagagaggctctggcggacggcgcggatgagatcgatatggtgatcaatttgaccgacgtaaagaacggagagtatcagaaggttgaggacgagatcagagccttgaaggaggccacaggcgaccgtattttaaaggttatcatcgagacgtgttatctcacggaggaagaaaagattgccatgtgccgcgcggtgaccaatgcgggggcggattttatcaaaacctccaccggattcggaaccgcaggcgccctgctctccgatatcgggctgtttcaggcaaatatcggggagaacgttaaaatcaaggccgccggcggcgtcagaacgctggaagacttaaagaattatgtggaagcgggctgcagccgcgtaggcgccagcagtgtggtaaagcaggtggcagagcttcagaagtaaaaagtggatcggtggttcctgtaagaaagtccggacctggcgaacgcgcctgtatttggcgcgaacgaaggggccggacttttctgcggctcaccattttcctctgttataaaacggaagtataacctgaatttataatacacattacttttatgtagttgacaaatagaagcaaggttgttatcattaaaattactatacaaaaaggcggggatatgaatggaaagaatcgtattatcgttgctggttgacaatacttccggtgttttgagccgtgtggcagggctgttcagccgccgtggctacaacattgaaagccttaccgtgggtgtcaccgcggatgagagatattccagaatgacagtggtttccatcggagaccaggaaattttggaccagatcgagaaacagcttcgcaagctggaggatgtgcgcgacattaaggaattgaagccgggtcattccgtatacagggagctgatcttagtcaaggtccgggccaatgccagtgaaaggcaggcggtcagcgctatcgcggatattttccgtgccaccatcgtcgatgtcggtaaagattctctgacagttatgctgacaggcgaccagtcaaagctggacgcgctcatcaatctgttggaagactatgagatactggagctggcgagaaccggtcttacgggactctcaagagggtctgatgacgtccgttacttaccatagttttatgaagttagctagaggtattgccaaaggcggacagagagtcgtcggcatagttcctttaacaataataatatgaatacatatatgaggaggaaataaaaagatggcaaagatttattatcaggaagactgtaacttatccttattagagggaaagaccattgcagtcatcggatacggcagccagggacatgcacacgcattgaatttaaaggaatccggctgtgacgtaatcgtaggactttatgagggcagcaagtcatgggcaaaggcagaggcacagggcttaaccgtttatacagcagcagaggcagcaaaaaaagccgatatcatcatgatcttaatcaacgatgagaagcaggcagccatgtacaaggaatctgtagaaccgaatctggaagagggcaacatgctgatgtttgcacacggcttcgcgatccatttcggacagatcgtacctccaaagaatgtagatgttaccatgatcgctccgaaggcacctggccacacagtaagaaatgagtatgtggttggcagaggaacaccgtgtctcgtagcggttcatcaggattatacaggcaaggcaaaagatatggcactggcttacgcgctggcattaggcggagcaagagcaggcgttttagagacaaccttcaaggtagagacagagacagaccttttcggcgagcaggctgtattatgcggcggtgtatgtgcactgatgaaggctggcttcgagactctggtagaggctggatatgcgcctgagaacgcttatttcgagtgtatccatgagatgaagctgatcgttgacttaatcttcgagagcggattcgctggaatgagatactccatctccaatacggctgagtacggcgattacatcaccggaccgaagatcgtaacagacgagactaagaaggcgatgaagcagatcctgacagatatccaggatggctcctttgcaaaggactggctgcttgagaaccaggtgggctgttctcacttcaacgcgatgagaagaaaagaagcggagcatccggcggagaaggttggtgctgaactgagaaagctttacagctggaatgacggcggcaagctgatcgataactaattagaatacgcgggagatggaaggtaactgccatcttccgcctttttttatttcacaggaaagttcctcctatgaaataaaaaccctccgggggatgcgcactccgcgctaaagaaatatggccgctgaagcgaccgcgctccggcgcaagagtccggctcgccggactctcttgtatggcgaatcgtaagtatgtctaaggaggctgtgtgatgaaacatttgggaacgaagagagtagagacagagaggctgatattaagacggtttacaatagatgacgcggatgcaatgttccgtaactgggccaatgacccggaggtaacgaagtatctgacatggccggctcatccatcggttgaggtttcaagaatggtgctggaaagctgggtgtcccaatatgatgacaacgcagtttaccagtgggcgattgtgcccagggacatcggtgagccggtcggaagcatcggcgcagtccatggcagagatgagatcgcaatggtgcacatcggctactgcatcgggaaaaaatggtggcagcaggggatcacatcggaggcgctggccgccctgatccgatttttcttcgaggaagccggaatgaaccgggtagagtcccgccacgatcctcataatcccaattcgggccgcgtgatgaaaaagtgcggaatgaagtatgaagggactatgaggcaggcggatatcaataaccagggaatctgtgatttctctgaatacgggattctggccgaagactatttcggcggaaagcaggcagagaaatagagcgaaccacagacagtacgagggaatgtaaagtaagcacttttttgtgctataggtacctaaaagaaactatgaatgagaaaccagacacaacaggaactggaggaagcaatggaaaagacattgccggcatgtccggttgagacgacgctgatgctgatcagcgacagatggaaagtgctgattatccgggatttgttagacggtacgaagcgttttggggaactgaagaaatccatcggttctatttcccagaaggtgctgacctccaatctgcgggagatggaggcggatggactggtgaacagaaaggtctacgcggaggtgcctcccagagtggagtatacgcttacggatacaggctacagtctgaagcccattctggacgcgatggttgaatgggggatggagtataagagaaagctgaactgagcataaaaatgtgagaaaagagagaaatagagaaataagaacggaccgcctgggacaacagataactgctgtctccatgcggtccgaattatgcaggcttcgcaatatccagttttcgcgatatccggttacgagatcggaaaactgtcacagaaggataagaaatcctctaacgctctggaagtcccccctggattataggcgaagccgatggtacgctttttgatcggccatttcatgggaatcgtgaccagtgtcttcttgtccagctcttcctgaacgaactcccggatcacacagccgattccgaggccgatcttggcgaactcgatcagaatatccatggtgtttacctccagcacctggccggggacgatctgatgttcgcttaagtactcatcgatgtattttcttgtcatgttgttccggtcaagaagcaggatgttgccggtctggaagatatctgtattcctgccttcccgcaggtataagttgtccagatacggtttcgtggatacgaagatatcctgaatgttcatcaccgggacgaagatcagcggttttctgctggacggttcggcgataagccccagatcgatgtgctgctgttccagcatggcgatggtgtgggtggtggactggctctcgatggtgatcttcacgtgaggatacttttcgatgaagccctttaagtaagggagcaggatatatttgcagagtgtgttgcttacgccgatgcgcagatggccgatattaaagtccttgatccgcttcagctcattttctccacggctcagtgcctcgaaggcggattccgtatggtgaaagagcagttccccctcgctggtcagctgaacgcctctggaattccgggtgaagagggagacacctaaactgtcctccagcttgctgatggatttactgatggcgggctgactgatgtaaagctccttggcggccttggagatgtttccggcctttgccacttcgtagaaaatcttatattgcgaaaggttttgttccatatatgcctcttttcctggtatccgttccggttggctctctgccctgtgcggcgcgctctggtccgtccccgtccagccggaatggtataactgactattatattaagtattcatattatgtatttctattatatcaataagtatgttagaatgtaaagcagaaaatgagaacagggtttgaaggaggatatagattatgggaatgacaatgacccagaaaattttagcggctcatgcggggctttcggacgtgaaggccggacagttgattgaggcggatttggatctcgtattggggaatgatatcacctctccggtggctatcaacgagatgaaaaaattcgacacagagacagttttcgacaaggataagatcgctctggttatggaccattttatcccgaacaaggatattaaatcagcagaaaactgcaagtgctgccgtgacttcgcatgcagacatgagatcagcaattactttgacgtggggcagatgggaatcgagcatgcgctgctcccggaaaaaggactcgtggtagctggtgatgcagtgatcggcgccgactcacatacgtgtacatacggcgctctcggtgcattttccaccggtgtgggaagtacggatatggcggccggtatggtgacgggaaaagcatggtttaaggtaccgtccgcgctgaaattcgagctggttggcaaacctggcggctgggtcagcggaaaagacgtcattttacatattatcggcaagatcggcgtggatggcgctctctataaatccatggaattcaccggcgagggaattaagaacttaactatggatgaccgttttaccatctgtaacatggccatcgaggcgggcggaaagaacggcattttccctgtggacgacctggccgttcagtacatgaaggagcactccaaacgggagttcaccgtttatgaggccgatcccgatgcagagtatgacgaggtctacaccatcgatttatcggaattgaaaccgacagtggcgttcccgcaccttccggagaatacaaagaccatcggttccttcggtgatatcacggtggatcagtcggtgatcggttcctgtaccaacgggcggatcgacgatatgagaatcgctgcaaaggtgatgaagggcagaaaagtggcgaaaaatgtccgctgtatcgtaattcctgcaacacaggagatctacctgcaggccatgagagagggacttctggagatctttatcgaggcgggagcgattgtgagcacaccgacctgcggaccgtgtctgggtggttacatgggaattctggcagcaggagaacgctgtatctccacgacgaacaggaactttgtaggccgtatgggccatgtggattctgaagtgtatctggcaagcccggcgatcgcggcggccagcgccatcactggaaagatttcagcgccggaagaactcggcttataaagaaaaaggaggacagattaatgaaagcgacaggttccgtttttaaatatggggacaatgtggacacggatgtcatcattccggccagatatttaaatattacagatggatatgagcttgccaaacactgtatggaagatatcgacagcgattttgtgaaaaatgtaaaaaaaggcgatattatcgtagcgaataagaattttggctgcggctcctccagagagcatgcgccgctcgttatcaagtgcgcgggggtcagctgtgtcatagcggagacttttgcaagaatcttttaccgcaacgccatcaacatcggcctgccgatcatcgaatgcccggaggctgctaaggccatcactgcgggtgacgaggtggaagtcgattttgacagcggcatcattacgaataagacgacgggacagtcctatgagggccaggcattcccgccgtttatgcagaagattatttctgcagggggattgattccatatataaatcagaagtagggtaccgtcccgaaaacggaagccggaggagcccggatataccagagacagcattctggcatatccgggcttctctttcatgatttgctgcctgcaggcagaacctgcggagcgcgctgctcatcacaaagcgggctgaaataatttttcctatacacggcgcgcaggcagtgctatattatatagaagaaacacatcagaaactgtcgaaagggaggacatgccgtatgacaattcaatttgccgcggaggaagacacagggctgatcctgcgatttataaaggagcttgccgattatgagggaatgctttccgaggtggaggcgacagaggagctgctgcgggagtggatttttgaaaagaaaaaggctgaggtgctgattgggagggagggtggagaaccggtgggatttgccctgtttttccataacttttccacatttctgggcagagccggaatttacctggaggacctttacgtcagaccggaataccggggaaagggctgcggaaccgcattcttgaagcgcctggcagagattgcagtggagcggggctgcggacgcctggagtggtggtgcctcgactggaataaaccgagcattgaattctaccgtgccatgggagccgttcccatggacgactggacggtttaccggatcgccggcgatcagctgaagaagctttccggacatgccggaaattcagaaaggagtgaatcagatggtgaagacgaacgccatgcgtatgctggacaaggcaaaaattgaatacagaacaaaagagtacgaggtggatgaggatgacttatcgggaagccacgccgcggacatgatgggagtggatcacggaagtgtgtttaagacgctggtgctgaaaggggagaagatgggctatctggtctgctgcatccctgtggatgcggagctggatttaaagaagacggccagggcggcaggcgataagaaggtggaaatgatccacatgaaggaccttctggccgttacgggatacatcagagggggatgctctcccatcgggatgaagaagcaattccccacttttgtcgaagaaagtgctgttttgtatgatgagatcgccataagcgccggattaagaggccagcagatcctgatttccccacaaaccctggtgaccttcatccggggaaaatttgcttccctgacgtttgaatagtttacataaaataaaaacgcaaaaaaacacaaaatttgcaactttaaataagtaacagaaatgtaacagatttgtaaagaatgaataataaatatagataaaaacatagcttgaaacaagctaataaatgtaacatatatacaaaaaatataaaaagaccagaaaacggtcaaggaaaatatcacaaagatgttaaataagtattgactttgttgacaagactcctctataatacgctcgtcacccggaaacggctgcaaaagtctgcggcttagatgtatgagagaaaagaaagaggagtatgtatgctgacattgcgctcaattcttcagcatatctgtcagttctttcggggactggcggtgaaggccacaaaaaggatgtatcgatcgtcggctgtctttatggcaggcgctgcggtgatcaccgttgtggcatttacctcgaccggtttcggcagcggaggaaagaacgccctgacggcgtttgcggaaactccggggcaggagacggcggcagaagaggaagatgcagaagaagaggaacctgttacggaagcaaaagtacaagtccaacttaccgaaataaagaagcagggacaactgttagccggtaatctattggaaaaagaagtacagcagaaacaggagatccaacaggaatcgaaagaagagctcgaacgtatcaatgaacagattgtcatggatgctaaaataaaggcgctggaggcagaagaaaatgcccgccagaaagctttggaagaagaaagacgcagggaagaagagaagaaagctgcaagccggaaggcggtctcagacgacgattatcaggttctgctgcggatcgttcaggcggaagccggagtctgtgacgagaagggaaagattctcgtggccaatgtggtgctgaaccgcgtgaagagccaggagttcccggattcggtaagaagcgttgtctatgagccttctcagttttcaccggtatcagacggttccatcaattccgtgaaggtgacggaggagacgaaggaatgcgtgaaccgggcgctggaaggggaggactattccgacggggcgttatacttcatgaaccggagaggttccagaagcagagctgtgagctggtttgattcccatttaacgtatctgttccgccatcaaaatcatgagttttttaaataaaaacattgtagaatattctgctttaggtgtatactatagctagacggcagcgggaagaaactctgccggaaactaagagattttatacataaaggagaacagggctatgatttttgactcagcgaagaatcttgatttttacagagggcttggaattgaaggcagatacgataaggcagttgatttccttcagaataccgatttagagaacctggcaccgggaaaatacgaaattgacggcaagaacgtttatgccaatgtaaccgaatacaccacgattccgtgggaagaggcgaagtacgaatcacaccatgattacacggacatccagtacatgatcacgggcactgagaccatgacctatgcaccggtggacgcactgaatgtgacagtaccgtataacgaagaaaaagactgtgttttatatgacaacgcaaatcctggattaaaggtagttgtcggagcaggtgaatatatgatctttaatccgtgggatggccataagccgaaagcagcagacggcgagccggccccgattaagaaggtaattgtgaaaattaaggaaaattaatgagatatctcataacggagcgttcctttcgcgggaacgctctttttttggtttcatagggaagttcgtcctatgaaaccaaaaccctccgggggaggcgcactccgcgctaaggaaatttggctgctgaagcaaccgcgctccggcgcacgagtccggcttgccggactcgttgtgtgaagggaggttttttgtttccgtaaccgttccagcgaaaaattccccctgaatcaaaaaaatgtggagtttttccccggccattttccaactataatgtaattacaaagaaatgaaacagaggaaaaatgtgaaagatatgaaggggtggaaccatgaaaaagaaacggctgacatacagtaacttttacttttacctattgctccttgcgccgattctggctgtctatatcctgttttttgttattcctgtggtatccagcatgtttttcagcctgacgaattttaatggaatcagcctgaaattcaagtgggtgggatttaacaattacgatgtggcgtttcatgacaaggtgtttaagaaggctatggtcaacacctttctgttcgcattgggagcgacagtattacagaatctgttcgcaatcgtgttcgcaatggcgctgaacacgaaaatcaagtccagaaacttcctgcggatgctgctttttgcaccgtgtatgctctcccccgtggtggtggcatttatctggcagtttatctatatgccggacggcatgctgaaccacctgctgggaaccgacatcacctggctgggaaacagaaagacagcgctgtcctgtgtggtgatcgctcatgtgtggatgtggatcggatattcttccaccatttacatgtccaacttacagagtatatcgacggacattctggaagcggcggccatcgacggagcggggccgtggcagaaattcaagagcattatcctgccgatgctggctccggccaccaccatcaatgtgacgcttgcgtttacccagtccctaaaggtatttgacattgtctacgccatgacaggcggcggaccgctgaactccacggagacggtgggaacgtatgtggtcgccaatatgaaccgcggcctgcacggctatgcatcggctcagaccgtacttttaaccatcgtgatagtcctgttcgggcaggttttaatcggagttctgaaaaaacgagaggaggcgatttactgatgaaaaccagaaagaaaccattgctatttctgttcgaactgctgatgatcgccgcctgcgtgctgatgttttacccggtgatcatgatggttctcgtgtccctgaaggatgaggcgctgctggctggcgagcccttaagcctgaagaccagcttcgcctttgaaaactatataacggcggcgaagggaatgaaatactggagggcgctgcttaactcttccgtattgacggtattcagctctttgatcaccacgttctttggggcctgcggggcgtatgccattatgcgggcgagaagaggaaagaagctctttctcgtactgaacgcgctgtttctcatcggtctggcgctgccgcagcaggtggccatggtgcctctcgtcttatggatgcagaagcttcacgtagccaatacgctgttcggactgatcctggcgtttatcggagccaacgcggcatacggcgtgttctttttttccggctttgtgaataccgtacccgtcaccctggaggaggcggcctatattgacggagccagcccctttacgacctttatcagaatcgtgtatccgctgcttaagccgcccatggtaacgcttttgatcgtgatcgccttaagggtctggaacaactttatgtatcccctgcttcttctgcagggtcagaattccaggacactgcctctcacggtatttttctttaagggtgacttgtccatccagtggaatattctgtttgcggcgacaaccctggtgatcctgccgctgatgatcgtctatttaatactgcagaagcagatcatttccggcatgttaaacgggtctgtgaaggggtgaatcagttaaatgcaatagtaacaaaatcataataaaggaataacaggaggaagaaacatgagaaaaagaagaacagcagcatggttcatggcggcagccatggtaatgggatctctggccggatgcggacagaaggcggcgccggagacgacggcagcacagaccagcggggcgaagaaggaagagaccgccgcagcggaggaaacaaaggcggaagcggagagcacgggagaacaggtggagcttaaggtgttcggatttaagaccggagcggaggaaggcgcgattccggaactgatcgaacagttcaacaaggagaatccggatatcaaggtggtgtacgagggaatcagcaacgcgggcggttatcaggatgtactcaccgcaagactggcttccgggcagggggacgacgtgttctttgccaaccccaattacctgccgcagcttcaggaagcgggctataccgaggatctgtccgatatgcctgtggtggagaagtacagcggcctcgtaaaggatttgctgaccatcaatgacagcattccgggtctcggcatggaagtggccgtattcggtatgttttctaacctcgatgtactgaaggaagcgggcatcgaccacgcgccggcaaactacaaagagtttctggaggattgtgagatcctgaagaaagccgggaagacaccggtcgtggccggagccaaggatggtacgggcgttgccattctctccctggcgaagagcatggacccggtctatcaggcctccgataagatggaccagatcgccagaatgaacagcggcgagctgaaattcggtgatgtgatgcagccgggatttgcactggtggaagacctgatctccaaaggttatctggacggaagcaaggccctcgtctatgcggcgggccaggacgatattgcagaattcgcaaagggagaggccggctttatgcctggcggaagctggttcgtggcaggacttgagagcgcagctccggatatgaactatactctgggcggtattccggtcgaggatgacgattccctgattctgatcaatgccggtgtccgcgtctgcatcaacagctcttcagagaagaaggacgcagcccggaaattcgtggaattcttcactggactggacagcatgaacgcctatgtggcaagccagaacagcttcaatccgcgcacggatggagccagcacggacaacgatgtggtggagccagcggcggagcgtctgagcgcagcccgcatggttccgtgggtggattccgcctttgacatcgcggtggtcagcccgtgggcggacgcccgtacctttacggccaatgtggcgggcggtgattccgtggacaatgcggtcaaggacctaaacgcacaggtggagaataatctgaagctgaaataatgcaggctggcagccgcaggactgagtcttgcggctgccttttacctatgttagaatagcacaagagagggggacggggacatgtatcggatactgattgcggatgatgagttctgggtgggccggtggctgagccaggtcttaaaggagagcccctttgaggtggcggtgacgggaatcagtgataacggggaagagacgttgaaagcgctgctggacaccagacccgacatattgattacggatatcaatatgccgctgatcgacggcctcgatgtgctaaaacgcctggagaaagcgggggaaaggctcccgaagaccatcgtcatatccggttacgacgaatttgactatgcgaggcgtgccattgagctggaggttatggcctatttattaaagccgctggagcggtcggcggtctacgaagccgtggagaaggctgtcgcggcgctggaaaaggagcaggagagaaaggaacagacccgggacggtttcacggcaggggtggaaaacatcctgacggagtacctgcgaagtcccggcgatgagacgaagcgccagcttagcagcctcctggtgtcaggacaggggcagagcggcttctttgaactggcactgtttcaaatgcgccgtttggaaaaatccgctctgacgagggaggagatgcgcggacgtctggaggaggctgctgccggtaaggacatctacctctgcccgctggaccgtttcacctggggtgtcctgatcacaggcattgtgaatcctgcgggcttccggctggatgagagcgtgcttgtgagtctgcttcacagctatgagtatgggctgagcgaggcgcatgaggcgatggaggagattggcgaggcattcgcggaggcgagggaatccatcattctgcggctggggcgggaagggaagacggagtcctttccggtgtcggaatccgatcttcacgcggattttctggctgcgttaaaggccggcaacatggagcgaatcagggagtgtacgagacaggcctgcgggctctttatccagaagggatacgacttaaccagctgcttaaatttctactttgttctgtcgggcgaggtgatcaaactgttaaatgaccggtataaggaacagagccggacggaatatctggaactgatcgaggagggatacgatttctctgtccggatccggaattactacagcatccggtccatctgccaccggtttgaagagtatattgaaaaggcagcgtcctgtctgaaggaagaggactgcatggatgtggcggcaattgtcaaacggatccagcgtgagatcagggagcattacagcactgatatcagcctcgcctgggtggcggacgaatacggaatcaatcccagctatttcagcaagaaattcaaggatgagacgggggttaatttcatcgattatctgacggaggtgcggatcggacaggcaaaggagctattaagccacacgggtctttccgtcagtgctgtcagccttcgggtgggatttaaggaagcaaagtatttcagccgggtgtttgcctccatgacgggggagaaaccgtcggaatacagggagaggatgaggcaggaggaggaaaaacgtgaagagagtgcgcattaagacgtggctggagagccgtctgaacagaaaaatatttttgagctttctgacagtctccctcattcctctttgtattgtctactgctatattaactccgcctattccgagaagctgaggagcgatgccttcacccagaaccagctgacggaacggaacacggcagttttgctggaggactatttgactaaaatcgaatacatctccaatctcttctttgacagcgatacccaggccatgatacgcggggcctccgattcgctgagcagctacagcgcccgcatggcgctggagaaaaaggtgcgggtgaatctcgatctgttcaaggtaatggcgtacgtggatcaggttacatttttaaaacaggatggaacggccatggatgtgatgaattccttaggctacgcggacaccatccttttttccgtaccgccggaggaggtgggaaaacggtttaaaaaccagaggcttatgcggatcgaggagctgaatgacagttacacggataaatacgtctatctgcgccagatcgatgatttagacttgaaaaacggcaccctgggctggctttttatcgtctttgaccgggaccagttcgatctgcttctccaggatttgcggacggtgctgaacacggagatcgccatggacgacggagagctgctgctctatgacacgatgagcggcgggccggaagcggtgaaccgtctgcgggccgccgcagtctcctactcggcgccgacgaaggagaggagacgggcggagagcatctcgtgggactaccgcatcgaaaatctgggaatcagagtcacatttttcgatgacatgaagggcgtggagagcaatatccgtgcgctgagcaccatgacaggaaccgtgatcttcataaccgtgctcatcatactggcggcctcactccttttctcggagaccatcgtccgcccggtgaccaggctccataagaatctggtccgggtgaaggagggcgattacacggtccgcgtgcacgtcgagaccagggatgaggtgggagacctctgtgacgcgtttaacggcatggcagaggagattgaccgcctcgtcaaccgggtgtattctgtggaactgaaggaaaaggaggcggccatcaaggcgctgcaggctcagatcaaccctcattttctctacaacaccctggatatgatcaagagcatggcggagctttacggggccttgcaggtatcggagatgatcatggccttatcgaagctgttccgctacgcgacccatacggacggtgtcctcgtcaccatcagggaagaactggaaaacctttccagctacatgacgatcgtcaatgccagattcggcgggcggattgcgttcgccgccagggttccggaggagctgcttgcagagcccatcgtaaaggtctgcctgcagccgcttgtggagaactccatctcccacgggctgggcaggggccgctctggcggccggatcgcggttacggtaaaaaaagaggatggaatcatgacggttacggtggaggacaatggcggcggcatacagccggagcggctggcggagatccgcggccgcctggagcggagagaacgggtggaagaggagtccggcaggggcaatgtgggactgaagaatatccacgacagaatcaggctttattatggagatgcgtatggcattgtgattgacagctttccgggaaagggaaccgtggtgacactgtcctatccgtcagacgagattccggccccggagatgataaaggaggaaccgatttgaaagagagacccaatctattatttctgatgacagatgagcagcgttacgacgcagccggatgggtgaaccgccaggtacatacaccggcccttgaacggatggcggaagaagccgtgtgcttttcccgcgcctataccacaaacccgtcgtgcattccggcgagggcagccatctttaccgggcgctatccctcccagtgcggcgtaccgggatttgtcagcagccttcccaaaaaggagaccacatttatgaagtatttacaggaggggggctactatacggctgtcatcggaaaacagcatttttggcgctctgaaattgagcggggatacgactatgaggacattgtggatgaacattttccgccggagataatcacgaaggagctggccgacggtgaattcggcctcccggccaacaagacggtctccgaccgcgtctccagctatgtggagtttctggccgacagcggtttcaccaggggatcccagcttttcagggagataaacagcaaggggatctatgaatttacaggggaagaaaagtaccacgtggacgcctacatcggcgaccggggaagggagtggctggaggagagctgtcccgatgacaggccctggttcctgaccctttcatttccggggccgcacatgccctttgacgggattgggcttccggatgaagaggcctacggggaaatggagctggatttgccgggaacggagctttccgatctgttccataagccgccccattatctcgacatcgctaagaaattcggcagtctcgatttaaagaatcacacgtcgccggatgggctcaccccggatgagatccggctgatgaagaaggcctactatgccaatatgactctgattgaccggaaaatcggccaggtgattgagttccttaaaaagaaggggctttacgataacaccctcatcctgtttacctcggaccacggggactttatgggagatttcggtgtggccaccaaggcccagtactgctcggaggccctgatgaggattccgtttctgttaaagcctccgttttctggctttaaaggccgcagagaggacagcttcatcagctcggtcgaaatcgcggccacatgcctcacggcggcgggaatcgctgtcccggataccatgatgggccggagtcttacacagttttacgaggacggcgccaaagaaatatggccggacgtctacatggaagcgagagacatccgggccatacgggatgaacattataaactgatttactaccagaacaggagctacggcgagttctacgatctccagaacgatccggaggagaagtataatttatgggatgatccactgcttcaggagcggaaatacgaactgatgaagcggcttctggaccggatgatcgacctcggcgagggcgggaagaccgtctggaatatcggcgctcccgtcatataagcggtgaagataagcggtgaagctttccgcgtgcccctattccggagcccagccgtcatttcctgagagaacggcggcctttgtaaagcgtccggcctcttctttcgtcaggcggcggacccattccgggcggcggtccatggcggcgcccggtccaaagctctcatactccgcataaaacgcgtgctctctggcctccggtttgttccagtcatcccatccctcttcgcagatatgggaatccatgtagcagttcaggagaaccgtttgggcgtattcacgccagggccgccccaggaaggcgctgtgcgggggacagcagctctcgaaacggcagtccttcatgacatagccgaattcctggccctcaggcgtggaggccgcggtgacgtagctgttcactgggctgtccgtacacttggaaaacagggtacagccttcaaaataggcggccgctccgccgaagatgaagtcgatatcgccctcgatgtagcagttccggtaataatgccttccgctgatgcggggggtattctgcttcggcccggtaaatcctcccggctcaatctcccttggcgggagaggcgcggtaaagagagtatcctggtttcccaggaaacggcaggagtcgaagaagaggcggtccccatccgcatagagggccagggcctgtccggcctcggtccctttcccggcgctgttttcaaaggtgatgctgcgtgcggtgaagtcgtgggtgtcgatgaagcatgtaaaggtgcggaacgttcggagcggcccgccctccggtgcttccatgcgggcagagaggcagccggtgattacggtggagccgtcctcttccccgaggaaggtcagatgcggtatgcgcacggtaatctgttcccggtagattccgctgtgcaggaacagcgtttctccttttccggaatccggagtttttgcaaggcagtccagcgcttcctgtatggatgaaaaatcttttttcccgttttgatcgatctctatcatagaattccttctttccaaatggagtagatatttttgcgattcgtactaaatatatccattttacgacaaatttgcaatagaaatgattgacttctaattcacaaagtgagataataccttaaactgtgaatggaattaattcaaaaatgcatatggggacgggagcttgccttccgtctccgttgcattcttatccatggaggagagaatggagaaggaatatctgttatttgatctggacggaacgctgaccgatccaaaagaaggcatcaccaaatccgtgcgccacgccctgaaggcttataacatcgaggtggaggacttagatacgctctgctgctttatcggaccgccgctgaaggacagtttcatcgaatactacggattcagcgaggaggatgcggtgaacgcgatcggtgtctaccgggagtatttttccgaccggggaatctttgaaaatgaggtctacgaggggatcgaggagatgctgaaggcccttacgtcctccgggaaaaagctttttgtggcttcctcgaagcctgaggtctttgtcagaaagatcatggagcatttcggactggattcgtatttcacctttatgggcggcgccgatttaggagagaccagagtgaagaaagcggatgtcatccggtacgtcctcgcggaaaacgggattaccgatctggaaaaagtgatcatgatcggtgacaggaaacacgatatcttaggagccagggaggtcggagtcgacagcgtgggcgttctctacggttatggagaccgggaggagctgaccggcgcgcaggcagattttctggcggagacagtttttgatttgcagaatctcttatagtgtgatatgatacacagtattatggcgcttaaggaatagttttggctgacggcgaagaggaacgccttaaggaggagacgcattatgattgaactgggaaaagaaaagagacagataatcagaccgctttgcggacaggcggatcacgttctggtgcatggagcggttcggggatatatgggccgtgtatgggtgccggagctgacgaatccatcgtactgcctgatacatctgggtgatttcgcatacctgtttggcatatgcccaaagggtgaacaggccatggagctgaaagcacagctttacagagaatgcggccaggattacatcaccccatccgatgagagatgggccgaatggctggaggaatccttcccgggagaatacagggttttatcccggtattccatgagaagggacaggaaccatttttcggaggaggcactggagtcctactgcgggaacctgcccgcaggaattcgattaaagaaaattgataagagactgtaccagacggcgcttaaggaggaatggagccgtgatttctgctccaatttcgaaactccggaggaatttgaacagaatggcctcggctttgtggccatggatggcagaaagattgtttccggctgttccgcctatggaatcagccagggaatgtttgagatacaggttgagacccggaaggagtaccagcggaaggggctggccctggcgtgcagcgcccggttcatcctcacgtgtctggagcaggggatctatccgagctgggatgcaatcagcttacagtcagtcgggctggcggagaagctgggatatatatttgacagggaatacaaagtttatcagctctacgatatggagagcggccttttaatggcgtagctggcaccagtacagtatttggaggaataccaacgatgaaaagagtaaaagtcggattctggggaattgattcgatcctggaatttgtaaaaataaccggcagcagccgtcataagatggaactggtctgcgggagcacggtggtggatgcgaaatctctgctgtcagtgctgtccgtaaaggcggcccaggcggtggagctggtgattcacgaggaatgctgcgaacgtctgctggagcgtctggacccttatattgagcatggcagcctgctggacagggcgcaccatttaagcgcctgaggaacgaacagccgccgcaggacagggctgagagcatgtccgccgggcgcgtcgtcttcataattaaaactgacaggaaaaggaacttgaaaaattgagtaaagtggtgtatactaatgctataaaaataagatgaattgtaattcctggaatgttcgacactcttacctactttgaacctacattttgacattcgggattccaatatttttaagcggatgtcaggcctccgatattgagtggaaggcagaagcttaagtgaggtcgcccacctagcaaggctaggcgtcaaacagtaagaaccggcattttggggttacaaaagaaaaaagcagcgagaaatcgctgctttaactttttacaaaagtatgataatgtatacatagggcaaagcccgtatcttaaaatacaggagaataatatgaaggaaacgaaattcaggaattatatatgctggggagtgaccgcgctggcggtgatcgcgctgagtatcgcgtttgctttttttcttacgagatttcaggtgatgaaggctggggtgagggcatttatcggcatattgatgccggtgatctatggagctgtcctggcatatctgcttctcccgatatacaacaggacgagaagccttcttgaaggatggattgcgaagggcgtaaaaaaggaaaagacagtcagggggttatcgaaggccggagcgacggctgtgagcctgatcgtcctctttgtgattgttgcgggactgttctggatggtaattccgcagatctacacgagtattatgacgctgcaggagggactgggggagaacatcaacaacctggcgctctggcttcagaagcttctggaggataatccgtccctggaacaaaaggtaatcccgatgtacgacgaggtgaccaatcaactggaaacctggctgaccacctccctggtaccgaacgtgtcgacggtgataagcggcctgtccagcggccttttgagcgttgtgctggcgcttaagaacatcctgatcggcgtcatcgttatggtgtacttattaaacatcaaagagactctttccgcacagggaaagaagatcatctacagcgtgctgcctctgcggatggcgaatcagtttatcgaagagctccgttttgtccaccgggtgtttggcggatttatcacgggcaagctgttggattccctgattatcggtatcatctgtttcgtatgcttaaactggatgaagatgccgtacgttctgcttgtcagcgtgatcgtgggtgtgaccaatgtgatcccgtttttcggcccgtttatcggagccgtcccaagtgccttcttaattctcctggtcagcccgatgaagtgtctgtacttcctgatttttatcgtactgcttcagcagtttgacggcaatatcttaggcccgaagattttaggacagtctacgggacttccgagcttctgggtgctgttttccatcctgctgttcggcggcctgttcgggtttgtaggcatgatcatcgcagtaccgacctttgcggtgggctacagcatgttatccggactggtgaaccgggcactcaggaaaaaagaactttcccttaatacaaacgactacaaggatttaaagcacatcgacgaagagaagaaaacttatatgagataagaggagcgcatgaataaaaggaaatttatcgcatttgcagccggaattcctcttctggttctcattttaattatcatcatcctggtcagtgagacgaagccgggtgggatatcgagagcggcggcctataagtcagccgcccttcttttgacggatgccgaaagctgtgaacagctgctgaaggagcagggccagaactatttttcggagaaggacaggaataactggtatgcgaagtatttgaattatctctacgtgaacggatacttatctccggacacgaccccttcggacccggaatacgtacagggatatttaacgtaccgggaggcggaggaactggcggaggcactggtcccgggacagggagaggctgctcacgtgggaaagaaaaaacagggcaaaacgtttccatcggacaactggtggtttatttacgacagccttcggaaggaactggatcaggaaggcagagtaaaggaaatagacgttctcctctacggtactccgatgaacatcaggagcgccccggcgtggaccgcttatacgagcgagggcaaattccgctttgaaggaatcagcctcgacagctacatagactgggaactgaaggtcctggtaaaagacggtgagatgatcgcggtcagggaaacggtgagtgattccgtcacctataagaatgtctggctgacacgcggcgagggggagaccttttccgtacatctgggcacaatcgagagaacgttccccatggaagcctctctggggcagccggaggagtttgccgataatctggcggacctgtctttgaagaacggcaagcttcagaaggtgactttgaagaaaaagagaattaccggaaaggtcctggcggtaaaggacgattccatcgagatcgaaggctacggtaagatcaagctggataaggatttcaaggtgtataagctgtatggccagtttgaggagcagtccatctcggatatcctggtcggctacgacattcaggaatttgtcgtggcccatggaaagctttgcgcggctttgaccatgcgggaattcgatgcgaagacgatccgggtcatgatcatgaatacgaactttcagtctgtcttccatccgtcggtcaccttatcggcggagagcggattgaacattgcctacggagaggagagcgtgcagatcccggcgaaggccgaagtgattatcgatccgtcggatgagcggctgaaggacggtcgaattgtcgtcacccccgtggatgccggcgataccatctctgtcaattcgatccgccggtccctcggcacgccgacgtacagcggaagcatcgaaatccggaaagagacagaggggatcaccctgattaatgaactgtatctggaagattatctgaccagggtagtgcccagcgagatgcctgacagctacgagatggaggcgttaaaggcccaggcggtctgtgcgagaacgtacgcctaccgccagattcagagcaacacctacagccagtacggcgcccatgtggacgacagcaccagatttcaggtgtataacaacctaaagacatcggataagacggagcaggcggttcgtgagacgtatggaaagcttttgttctatcaggatgcgcccattgaggcattttacttctccacctcctgcggccatacgacagacggcagcatctggggaagtgatccggccaaatatccgtatctggacggctgcctcctggagacagaccgcagcgtcttaaatctgtccaccaacgcggcatttgaggcatttatcaaggataaggagtacccctcctatgattcctccttcccgatgtaccgctgggagactacggtcacgaaccggcagctggaggaggagattaccgcggtgggaaccatattgaatatctccgtcaccgagcgcggtgtgggcggcatcgtgaaaaaagtgcgtgtggaaggctccgatggaatcatgaccatcaacggggaaggccaggtgagagcaaagcttggcaatccctacatgaagattacgaagaatgacggaaatgtcatgaaggatatcgagtccctgcccagcgcgtatattgccatcgagaacgagggcgtggatgataataatatcaccaccttccatatctatggaggcggatacggccacggagtcggcatgagccagaacggagcgcaggccatggcggcggaaggcaaaacctatgaggaaatcctccggttcttctataatggagtggaggtccgggaggccgagaaggagacggcggggtgacaggctccggttcgagtccggttatgtcagcagaataaaatatatagaaaaaagaaagaggctgttctttgccgtgaatcaggcaaaggcagcctctttgtgtggggcgcgggttcatctcatccgatactccttcggcgtcacagccgtaagctgcttaaaacgccggataaaactggacggcgacgtatatccaatggaagcggatatctccccgatcgtcatggtggtggtggtcagtaagtgtttcgcccgttcaatccgaagggaatcgatataaacagacagcttgacgccggtagctgtcttgaactgatggctcagattggagaccgacaaatgaaagcggtcggctaccgaggacacggttaagtcgtattcctgatagtgctgctgtatgtattcgatgacggcctgaatggaccgggaggtatctcccagttcccgaagctgaatcagccctgagatctccccggtcagcgtcagcataaactcgatcagtccggccttggagtccggcgccttcagggagacgatattatacgttcccgccgccttttgaaaggcgtgggagatggtataggtcagaggcggaagcagcagatggcggtcatccagccggtcgatatacttcatcagctcctggacgcatgactgcagcttttcgccatcctgggcggctaacgcgtcatagaggccggacagttccttttccggataacgccattcctcctccgtccccatcggcaaaaggcagttaaagaagcttaaacattctccctcatagtccgggtcctgacgtatgagctcccagcactctgtaagtgcagccggaaaatccccgagagaatcacagagtgtgcttacacacagcttaaaaggcacagaaagctcagctaacagatgatccttaaagccagtcagcttttcccggaggacgtcctctgcggattcggagaaaaaggctatcagaatatacatatcctcccattcctgttccagcgccagcagttctatgtcactccccccaatctcccggtacttctccagaatccggcggtcccattcttttgatgcctctgtctcactccagcgcagggcaataattagataacggtcgtgtgccgtatcaaccatatagggagaattcccgttaaaatcttcaatgctcttatagctgccgttcagcagcttcagcaggcatttctcgcagtccagctgctggttgtgcgtatccagaatatccatccccatggctacccggtccagggagtgcatctcccccggcgtgtttaatccgaaccgctccagagaggcgagaagccgccggatcggcttgtaatactgatgggtcaggaagaaggtaaccgtaaatcccagcagcagaatcagcgcgtccaggacgataaactggcctgacagggagtttgccttctgaagtagcagcttctcgtcgatcacgctcatataagttaagtccgtgtcagaagaggtcaggcggctgataaaaaggtttccgctgtgcaccgtctctagacgggaggagtccgactccgaaaaggcttccgtatcgacggtgagctctggaggcatattggaatacagcctggtatggttccagtcgatcagcgtataggcgtcatagctccccgaagaaacatcctgtaaggactcatcaaaaaatcccctgtcgatgcggaagacaaaaaaggccgcctgattcttcacggggatcacatattccacggccggctggccggaggtcaggagggcctggtctgcggggaggaaagaagggctgtagaaggcctccatcctgtcccggaagctggaaaagtcctctgaaaaaatcgggttgattcctgcgtagccggagatattgtacgttcccttgcaggagtagagcgtatccggcgtcactttcccgttatagtagtagatgtccagcagcgcggaatccagggagcgtgcgccgtttaattcggaatagatgttatagaaggagcttgcgtgcgcggaaatatacccgtcagaaaaatactggttcatggtgagattggtagcgatcttatggatcagatcgatctttccgtcaaagtaaatctgggatttgctcagagaattcccctcctggcggatggtttccgtctgatacaggttcaggaagtaacgctgacagcagaccgttacggcgataaccggtatgaagatgataaaaaaataagtacagagatgtttcaaatattcttttgcaatattctggttcaatagaatcccatccttctcaattattgaagatcacttcaaatactggcaatcgatccccggatttctccctgccgggcaccgctttcggaaccttaacaaaagtatcatactctcataaaagaatcaaggaaaaacagcttttttcaaaaaatgtttatagtaaaaatactgtttatttacatcattttcaaaaaatgttgtaataaatgtactaaaaaaataaaagggggaacgaaaaaattgactaagttgcttaaagaaagtcaaaaaaaggcagccgcatccctgcaaacaccgtctcagcgtgcggccgaacgaagagccgggagaaagcggacctggatgctgatgaaacggaattacttcctatatctgttcatcctgccatcctttctctacatcctgattttttcctattggcccatgtatggagtccagatcgcatttaaggattttctgccgtacgcgggaatgatgaagagtccatgggtgggatttaaacattttaagaaatttttcgaatccattatgttctggaagctgttgggcaatacggtgtcgctcagcctgtatgcgctgatcgcctcctttcctctgccgattatcctggcttttatgatcaattatacaaagaacgcccgtctgaagaagttcacacagaccgttacctacgcccctcatttcatatcaacggtggtcctggtcggtatgctctccatctttctctctccgagatcgggatttatcaatacgattatccaggcattcggaggaaagtccgtattctttttaggggaggaagggtggttccgccacgtatacgtgtggtccggcgtatggcagggcaccggctgggcctccatcatctatatcgctgctctggcgggagtcagcccggagctgcatgaggcggccatcatagacggcgcgtccaagctgcagcgcatgcggtatatcgaccttccgtccatcatgcctacggttacgattcttttaatactgaatatgggacagatcatgaatgtgggatttgaaaaggtgcttctgatgcagaacgatctgaatataggcatcgcagaggtcatctcgacttacacttataaggtcggcctcgtaaatgccgagtacagctattccaccgccatcggtcttttcaacaatatcattaattttgccattctgctggtcgtaaaccggggcgccagaaagctgtcgggaaccagtctgtggtaggggaggagtatttatgaacacacacatcaaggaaggactgggggaccggatattcaacggtgtcaccctgatcctgatattactgattatcgttgtcgtagcctatccgctttacttcgtgctggtggcatctatgtccagtcctacggcagtcaactccggaaagatactcctgtatccggatggcttttccctcatcggctatcagaacatcctgcagaataccaagctttggagcggctatgccaacaccatattctatacggtggcagggacatttttgggggtatgctgtaccattatggccggctatgcattttccagaacggaccttccggggcgcaatctgctgatgggactgttcgtgtttaccatgtatttttccggcggcctgattccgctgtatttggtggtaaagcagcttcacctgattaatacgaggggaatcatcgtgctgctgggaagtatatccgtttataatattatcattgccaggtccttcttcacctccagtattcccaaagagctgcaggaagccgcctttgtggatggctgcaccaaccagagattctttgtctccatcgtggttcccatctcaaagccgatcattgcggtgatcacgctgtactgtgccatatcgtactggaactcgttcttcaatgccatgatttacttaaatgaccggaataagtttccgctgcagctcgtcctgcgcgagattctgctttccttccaggtgatgcagcagcaggcggcgtcaggcggcggtgtggatgcggaaacgattgcggagatgaacaccctggtggaggtggtaaagtatggcgtcatcgtggtagcggcggttcctgtgctgtttatctatccttttattcagaaatattttgtcaagggcgtcatgattggagcggttaaaggctgatccggtccgcagaccttaaaacgcgcattacccggccgcctgcttccggcaggtccggcctggccataaacataaaatgagaggagaaatcgtatgaaaaaaggaaacgtatttacaagagcgctgactctgacactggcgggttccttgctgctcaccggctgcggcgggggaagcaaaacggcggagacgaaagccgcccaggaggcagtggattccgacggcagaaagatggagggaaatctctacacggaaggactccccatcgtaaaggagcaggagacctttaccatcgctgtcatcggtcatcccctggccaagggggcctacgaggataagccctgtgtgatccaggctgaaaaggataccaatatcaagatcaagtggatggagatcccttccaccggatggcaggagaagatcaacgtcatgtttgcctctggcgagcttccggacgccattgccacgggaatcacagactcttccatcgtaaaaaatctgccccagctggtaccgataggagattatatcgataagtacgctcctcatgtggcagagacgtacaacaagtatcccgatctgaaaaccatgctaaagcaggatgacggaaagatttattccttcatgacaagttcccagactgcgagaaatgactccaccagcggcgttctcttcatcaacaagcagtggctggataaccttggacttccggtccccgccacggtggatgagtactacgctgccctgaaggcgtttaaagagcaggaccccaacggcaatggagcaaatgatgaaatcccattctccttctgccagcagtattactcctcccagtttaaaatgatgatgggcgccttcggcatcaaggatgacaccgaccacatcatgtttgagaacggaaaggtggagctgtctgcggcgaagccccagtattatgacgcattaaagtactaccataagctggcttccgaagggcttctcgacgtggaaggcttcagccagacccagcagcagtattattccaagggccagcagatggtggtcggttcctttttggagttccttccttatttcgttgtcgggcaggagaatgacagccagtacattcccctcgcaccgttaaaatccgactccggtgagcctttatgggatggaataaaggataagtttgccggctggcataacggcttcgtcatcacgaaagcgtgtaagaatccggaagcgctggtacgctggttcgattactgcaacacggcctttacgacgaaaatgcagtggttttacggtgaacgcggcatactctgggagatggatgacgagacaggggagtggtggaacgtcaataattatccggaaggacagaccaagggagagtaccgttataccatgtccacaggccctcacgcccccgtttttctcacaaaagacgattgggataaattcgttcagaaggatgatcccctggcagaggaacgcaaagactgcatcgaccttttagaaccgtatttcccgaaagactatatattgccggtatttgagaaaacggcggtcgtggaggaaaaggaaaatctcagggtggatatagacaattacattaagaattttaccgcacaggccgtattgtccggtattgacgacgccggctggaaggagcacttagccaagctggagaagctgaatacagcgcggtatctggaactgcagcagcagacgtatgacaatacaaacgccaattgatcccacggcagcaggtccgatctctccgatcaggggacggcatggaaggagacagaaacaaaatggagaagccaaacatattatacatattttgtgaccagttccggcgtcaggctatcggatatatgaaggaggacccggtggtcacgccgaatctggaccggtttgccggtgaagcggtggtatttaaagaagccgtcagcacttatccggtctgcagcccttacaggggaatcctgtttacgggtatgtacccgcacgaaaaccacatctttaccaactgcacctcccaaagtgcggcggaaggctgctatcttcacgatgatcaggtatgtctgtcggatcttctggcagcgggcggatatgagatggggtatatcggaaaatggcatctggatgccccgaagcccgaacagaatccttatacggagggcttccgcggaaatggattgatctgggatgcctacacaccgccgggaaaggggcgccatggatttgatttctggtactcctacggctgctatgactggcacatgaagccccactactggaaaaacgatgcgaaaatcgacgagcggattgatgtaagggaatggtccgtggcgcacgaaacaaaggtggcgatcgattatattaaaaatcaggataagccatttgcgctgtttatgtcctttaatccgccccacacggactttgacatgttcccgcaggagtatttgaacgattacgagggcaaagaggccggagacctgctggtccgccccaatgtgaggatgattccggaagccgtcaggcacgtgaagaattactttgcctccatcacgggaatcgatgagaatttcggtaagctgatggctgctctccgggagaagggaatcgaggacaacacgattgtcgtcttcacatcggatcacggggaaatgatgggaagccaggggctcatgcacaagaacatctggtatgaagaggcagtgggcgtgccgtttctggtacgctggcccgccagattctcccaccacgacagtgacgcccagctgtctaccatcgacattctccccacgctgctgtccatggcgggtcttaaggaccgtatcccccagggctgcagcggctatgactttacccgtgacatggagacggaagactattccggctcgccggagtactctctctatgtggtatctgacccggagagcaatggcttcggaagaggtctccacggccggcgctataccttcatcctgtcagcggcccaaaacacaacggcatactacctgtatgaccggctggaagacccctatgagcttcataatgcggcgggggaaaatgaggaaatggttcaatattatctcggactgttaaaagagaagctggaagaaatcggggatccgtttttggaagagatcccatcatggggcagccggctccatgagacggccgcaagccagtgacaggaaagaatccgaatacacccgtgccatgatgcgtatgatagagtaaaagaataacgcagagaagcatatgcagaatcagaagctggaaaacctcttaaacctctctctcagtgccacgacagaggaacgggaaaaatcggagtccctgaatgtggggtataactccgagctgaatacatgggaactgatcgtcaggtattccgggagcctggctgagttgacagaacacgggatcattgtggatgagatgatcaacgagtacgccattttaacggtgccggagccggagatcgactatgtcagcagtctgccgcagatcgatttcatagaaaaaccgaagaggctgtactttgccattaaccaggcgaaggcagcctcctgtattaatctggtgcagcggggggagtcggacctgtccggcagaggggtcctggtggcggtcatcgattcgggaatcgattattaccacgatgatttccgaaaggagaacggggacacccgcatcgtcatgctctgggatcagacgctggaccgggtgtttacagaagaggagatcaacgaggcgctggccgcagggagccgggcgggggcaagggcgatcgtgccctctgtggatacgagcggccacggaaccgcagtagcggcaattgcagcgggcaacggaagagagaataacggacagtaccggggaatcgcgtatgagagtgatctcctggtggtaaagctgggcgtgccgagaagcgacagcttcccgcggacgacggaactgatgcgggcggtcaattttgtggtgagagaagccgtgcgccggagacagccggtggcggtcaatttaagcttcggcaacacgtacggttcccatgatggaacgagcctcctggaaacgtttctgaatgatatttcgaattacggaaaagcggtcttcgtggtgggaaccggtaatgagggggtgggagacgggcacagcgccggccagctggtgatgaaccagccgcaggaggtggagctgacgatcggggcgtatcagaccagcttcagcatccagctgtggaagtcctatacggatatctttgatatcagtctgattacgccgtccggcgagaccatcggtccgatcagcagccgtctggggccgcagaccatttcctttgaaaacctgacgatcctgctttactatggaaagccgggaccctacagtgtggcgcaggagatttatctggacttcattcccaaagcaaattatgtggaagaggggctctggagaatccgtctgacgccgctggagatcgtggagggaaacttcgatttctggctgccctccgccagcgtgctgagccgttcaacccgtttcttaaggcctacaccggagacgacgctgaccatcccctccacggcggcaggggtcatatccgtaggcgcctatgacgacgcttatcagtcctttgccgatttttccggccgcggttttacgcgaaagaccaatcaggtaaagcccgatctggcggccccgggagtcggaatcatcacgtccaggtcagggggcggctacgagtccgtgacgggaacctcctttgccacgccgtttgtcacgggaagcgcggcgcttctgatgcagtgggggatcgtggacgggagggacccgttcctgtacggcgagaaaataaaagcctatttaaggcggggagccaggcatctgcccggatattcgcagtggcctaatgcggagctggggtatggaaccttatgtctgtcggagagcattccgttataaaatcggcctctgcggcagccttcagggaaccttcttttacagcaataccataaccgcaggtgcgaaacatggcaatgtcttcctcggaatcgccgacagccgccgtctcacggggatcgattcccagaaatgcacacagttcgcggaccccgctccctttgtcggcctcccgggaaatgatctgaagattgccgcgctccgtgaaacagcggaacgcgccgggcgccagaagtccggtgaccgccttcacctcttcctgcctccagccgcgtttctgcggtctcgtgagcgtaagcttataaggacggccttcgtgttcaaagaggcggaggcgaaagcggaagtcggactgaagcgccgagagctgagggagccagggggcgtcgaaggtgtggaagatctcatgccggtcgtcccctgagtggtctttcgctgtacgatctttccctgcctgatcatttcctggccgaaagaccacatgcgcgcctcctgcaaagacacctcctgatatataggggagtatgctccggcatttggcggtcgcctctttccagggcagggaggtggccagaaataaggacctggtccgggactcgcgtttgaaaaagtccagccattccccactgatccccggagggggaaggaggcggtcctccgcccggccgtttttaggaataagcgttccgtccagatcgagaaacactgccctgggactccaggggatgcgaaaaagaggccagcgcccgaatgcggtccgctcctcacagtccatccggccgccataggccaggtagcaggtacatgcctttttcctgcatggaagtgtttctgtccctcccgtatcataccagtttccttccgggggagcggagatggtacagcgcctcattctgccgtcagactctacaaaaaggcgtcccggacattgctccggcatcgccttttttacgtgcagttcgcggtaaaaccagggatcgatcctgagaaatgcctgctgttcttcctctgtgtagcggcggttcagcccatccatgcggttgatccagaggcagcatccgccgggaagtgcctcctttaagcgccgaagcgtttccaggttctccggcacgccaactgcccccgcacagacgcggattccggcagacagcagttttctgcactgctctgcaaagagggggacggtcgtcatctccggatgaaaggtggcccagacgcggagtttttctttcctgccgccgttttccttgaagatggtaagctggcgctcgatatcaaagcttacgttggtctgcgcaccaacggcttctattgtccccatgcggctcagccgggcaagcccctcccagtagtaatcgtggatcagcgcctccccgtaaggaaccaccatgacggctccatacggttccccctgcgtttccagatgtccgacaaaccgcatccagtcttccctgtcctttaaaagctcagacggagaagagggccgtttggcgaaggggcagtaggaacagccgtaattacagctctttaaactccctctgtattggatcatgtttcgtgccatgatgggcctcccattgattcattttatcctggacttcctttgaaatgagcatggggcctagataatcggacagccccatccctttttccgtcagtgcgagacagtctccctgctcctcaagaaagccctgctccatccactcatgaagaattggaaaatcagcggctgcgtcaccatgaaacgcttcccggtaagccgtgagaggaagcccgggaagaatgagcagatggcgtatgacaaatcttcgtttctgttcctcttctgacagcagaatcccgtgggtgactgcgcagaaatccgtggtctcttcgtattggaccagctgctctaagcagctttctcttgtgacggcatagggagtacaggaatggaggtttcccagatagcttctgccgccgcatcccagtgacagcgtgctcccaaagccgcagtctgaaaattccctgctgcccccgggcgattccggcctgacgaaccggcgcatggaatcctgacggtaaccgtgcgaggcaagccattccgcagccgcttcatactggcggaaggccaggccctcatccagaacgaggccgcagtttaattcctgttccagcgccgcgccgtgttttacgtacagaggatagaggaacagctcgtcagggccgaaggataccgcttcttttaccgaggagaggaaggaggagacgctctgtcccggcacgccgtagatgaagtccgcattgaccctggaaaaaccgctgttcatcaaaagatccagcgattctctggccttctctgcccggtggctcctcttaaggaccttcagctcctcatcgaaaaagctttgaatacccatgctgactctcgtgacaccggcgtccttcagcagagcaagctttggcttcgccgtctgattcggcgcggtctcgatgatgatttccgcgtcccgggtaagccgtgtataacgccgtatcatggcaaagcaccgttccagctgcgtttccgtcagcagcaacggggttccgcctccgatcgtaaggccggtaaaaagggagtttgcagaggcaaaaagcggctcatactggcgaagctgccgttccacggtgtctaaataccggtctatggccgtctccccctgcctcgtgacggagaataagttgcagtaaccgcatttcgtctcgcagaaggggagatggaggtagagatcatgcccgggaccagccagatcaggaagatactgattcagagtaactccttccaggggaccgtaggccgtcttatggggatagctgtacatatactgcgtatatcgtttcatattcattggtgttgaactcctgaccttaaagggtaaaatgcttatagggaaccgtggttacggccgggtgattgatgccgtgaaactggcagccgtcttccccgtaacacgttccatgatcggaacagcagattacaaaggtgctgccccgcaccgccttccagcgttcaaacagccggcccagctggccatccacatagcgcagagctgcgccatggctctcaaggctgtcatgaacggcgccatccagataaaagtaattggggtaatggatagcgtcgatgtttaagtagagaaaaaccggaatgtccctgtctgctttttcgatcttctttaagagaaaatccacctgattgccggtgctgtccttgacgggacaggcaaaggaaggattccagtagctgcggcggaaatatccgggaaatacccggcccaggtcggagcgcttgtcaaaaaatgccacgccgcccacgcaccaggtgtcgtagccggccttctccagcccttccatgatggtcgccccggaaaatccaaaggcgccggcgggcgctctctttcccatacccgcgtttaccgggaagaagagaggctgccggtccgcgatgcttttggcatcataagggcagggcagaaatccggcgaacatggcgtggtgggagggataggtgaaattgccgggagcctggcatttctcccaggggccataccggttcagtaccggcgtcgtaccttttgattcctcctccgcggccacatcgtagcgcagggtgtcgaggcagataaaaaggatgtcatggctgcctgcgattttattcatatcgacatccggctgcatggcgttcagcgtccggccgaataagccggccgggacctcgcgcagtgcttcttggcgcgtaacattttcgtgcatcaaattatcatttatcaaattatcatttatcaaattatcatttatcaaatcatcatacatcgaattatcattcattgaattatcatgtatggcatcatcgctcataaagtacctccctgctccagccatgccttcatcatcctgacctggtggctgtaaatttcattcttatcataaatatcctggtaaagcaggtcgccctgtccgttcatctcgatgatccgtggctttaagctgcctttttccaggagaatatcgatcccggcgctgcgaaggccggggtaacagccgcaggccctccggcagagctcttgtatggtcgaagtgacgtcttccggcagcgccagacgggaggcctccagcgggtgattgtttaaatggagattggtgacaggccctttcgacagccgtgccagcagaaaatcgagggctccatcctggcagaccgccctcaagtcgtaggaaaatccctgaaagtccgccttcgggtaccaccgttccacaatacatccgagggagagcagactgtctaaaaaatccaggatttctgcaggctccgtgatggtgtgaagtctcttcgtattgataagcggcggtcggaaagaagaggaacgctccggctttaatgctgcctgatcgggtgcggcgcaggagtaggcggccatgcgtccagtctttggctggaagcgaaatgccgtgaccccggccgcgccggatccggataccggtttgataaagaccgaaaatatccgcatatccttcatgcgggagagaagcgtttcgctgtccccgatgccttctcccaggctttgggtaacgggaagaccggcctcctttaatacctgcttgcatctggtcttgtcgagcagctccatgagcgcacgaggcgtatttaggaattgggagactgacgcctccttttccaatgccttcaaatcactgcggtaggagccgaccagatcattgaggccggagagatggccatcggtccagacagggggatcaatctttacaaacagttggctgtcagcgggaaaaccgcagcgcctccactcctcccactccagaaacagaaagggcagtccgttttggcgggccgccttttcaaagtagatggttcgcttcgtgtcccggtttcccagcagcaccgcggttctcattctgtcagcatggcgttcatccagacctcgccgcggtagttatccggtttgttctgttcggacagctccgtctcgatcggaagcgcggccagacgctgcatcatcccggtgcttaagtagtggtagtgggcatccagcttctggatattgggatgcgcgggcagcgcttcaagtagaagggcgcctcccttgtcagacagagtcccgcaggacaaatccagtgtgtggatctggtccatatagcggcaccccagtacggttttcgtcatctcatcctgcatctcactgtcaacaatccctagatactccagattcggaaaatccatggtgtcaagcagagaacggatggtctcacagtcgccctcaaagccgtaattatcgcttcctatgtagagaatcagcttttttaaaccgggcagacgcgcatttttaacggactcgatgacagaattcggaagtccgccgcagatgatggtgagcgattccagtttctcatgagagacagcgcccagctccagatcggtgcttcccttgatggtcagctccgtcagctccggaagcgccgcccataagccgccatagttgccctgaatgatccaggatacctcgcactcctcgaaatccatgtctccgataaagaggctgcggatatgggaaaattctttcgcgtgtgaaataattccgtcgatgattggctggcagctttcctcccagcaatcgccccagtttcctatggaaagctctgtcaatccggaaaaatcagggtcggcaagaagatcatcaatcagagtgtgggctccctttgtcccgtcttcatattcatcgtattcgtagctgaaggttttgcttttgttcatttgcagatgtcccctttcgtttcatggctttattttagcataaccggtgagagaagtcatccccgtaatcgtccaaaatcatattttcggcagccatagcaaaacgaagacagagaaagaagaaatcgtaaaatatgcacaaaaatcgcttgcggctccctgccatacatgttatactttactcgtaaattgaatattcggatgaagagttcgggagagaccgcctttactggcggagccgaaggtgagaaaaactctcaggcaaaaggaccggatttggacgaaactctggaaaggtgatggacaccaccgacgaggcagctttccagccgtatgttcctcagaccggacacagcagccgtggactggatcagaaaaggaacggcgacggctgaaggtaatctttcaggtacgaagacggggcatatgacgattcttgttgtatgctttttttgtgtccgcagcagtattgttgtgtcattttgagtatgcagaggaactcaaagtgtggattgaaataacgatcttgattggaggaagggaaacatggaatgtaagacaactttatatgatactcatgtaaagtacgggggaaagatggtgccgtttgccggatttcttctgccggtgcagtacgggaccggagtgatcgcggagcacatggcggtgaggacggcctgcggcctgtttgacgtgtcccatatgggggagatcctgtgtgagggcgaagcggcgctcgacaatttaaaccatctgctgaccaatgattttaccagcatggtggacggccaggccagatacagccccatgtgcaacgaggagggcggcgtggtggatgacctgatcgtttacaagatcagagacaatcactattttatcgtggtgaacgcatccaacaaagacaaggacttcgcatggatgatggcccataagcttcccggcgccgaactgaaggatatatcggcgggagtcggccagctggcgcttcaggggccgaaggcggaagagattctgctaaaactgacagacaaagagaatctgccggtaaaatattacacctgccttgcagaccgtccggtggcgggaatccgctgcatcgtatcgaagaccggctataccggggaagacggatacgagctctacatggatgccgggaaggcgccggagctttttgaggcactgatggaggcgggaaaagaggaaggtctgattccctgcggactgggagccagagacacgctgagactggaagcggccatgcctttatacggccacgagatggatgacaccatcactccgctggagacgggactctcctttgcggtgaagatgaagaaggaaggctttatcggaaaagcggccatcgaggcaaagggagaacccacacgggtgagagtcggcttaaaggtgaccggccggggcattatccgggaacatgagaccgtctatgcgaatggggaagagatcggcatcaccacatcgggaacccacgttccttacttaaaatgcccggttgccatggctttggtaaagaaagagtatgctgtgcccggtacgaaggcagaggcggacgtaagaggacgccggattgaagcagaggtagttccgcttcctttctacaaaagaacgaaatagatattccacgaaaatataaattataatatggaggaaaaaacaatgacatatccagaaaatttaaagtatgcaaaatctcacgaatgggtcgaatttttagaggacggttcagccagaatcggtatgacagactatgcgcaggatcagatgggagatctcgtattcgttaatcttccggagccggaggatgaggtgacggcaggcgaggcgttcggcgatgtggagtccgtaaaggcagtttccgatgtctattccccgatcaccggcgtggttgcggaaatcaacgaagacttgctggacagtccggaaagcatcaattccgatccgtacggggcctggatgatccgtgtatccgatattggggatcaggaagagctgatgagcgcggaggaatacgaggagttcgtcaaagaataagaacgttagatgcagctgtaagagggcaaaaaggagaatgcaaatggggtcttacttatccagtaccgatcatcagcagaaggcgatgctcgatgaaatcggttataaagattacgatgatctgttcggctgtgtgccggattcagtgaagttaaaggggcggctctccatcccggagggcaaatcagagcttgagctgcgcaggcagatggagtctttggcgggaaaaaaccgtgtgtttgaccatgtgttccgcggagcgggggcgtaccgccactacatcccggccatagttaaggaggtggtctccaaagaggagtttgttaccgcctatacgccgtatcaggcggagatcagccagggaaatttacaggctatcttcgagtaccagaccatgatctgtgaactgaccggcatggacgcggccaacgcgtcggtctacgatggggcttcagccgccgcggagagcgtattcatgtgccgggaacggaagagagtcagagtcctggcggcggacacggctaacccggatgtgctggcggcgatggagacgtactgccacggcagaggcgcccacgtggaactggttccttcaaaggacggaagcgtcgatttagaggcgcttaaggagatgcttgatgagacgacggcctgcttctatgtacagcagcccaattactacgggattctggaggaggtcacggccatggcggaactggttcacgacgccggagccaagctgatcgccggctgtaatcccatctccatggcggttttacagactccggccgaatgcggtgccgatatcgcggtgggagagggacagccgctgggacttccgatggcatttggcggtccttacctgggattcatggcgaccacgcgggatatgatgaggaagctgcccggacgtatcgtgggggaaacggttgattccgacggaaagaggggctttgttctgacgcttcaggcgagagaacagcacatccgccgggaaaaagccagcagcaacatctgttccaaccaggcgctctgcgcgctgacggcctcggtctatttatcggccatggggccggagggacttcgggaggcggcgctccagtgcacctcgaaagcccattatttgagagaaaagctaagagcagccggtttaagtccggtctatgacaagccatttttccacgagttcgtgacagactgcccggcagatacagagcggctgtccgccaaactggaggaagaaggttacttaggcggtctgcctctgccaggcggacgcatgctctggtgtaccacggagatgaatacgaaggaggagatggaccgtctggccgatctcgtaaaggaggtgtgctgcgcatgaaactgatatttgaacgaagtgtaaacgggcgtcactgccagattctgccgccatccgacgtgccttacgtgatgccggagtgcacgagagcgcttccgctgcgccttcccgaggtatctgaaaatgacataagccgccattatacggagctggccaaagcgacccacggtgtcaacgacggctgctatcccctgggctcctgcaccatgaaatacaatccaaagatcaatgatgagatcgccggactccccggatttacaggaattcatccgctgcagccggaatccaccgttcagggcgccttagaggtcctgaagacttcggaggaaatattctgtgagataacaggaatggacagcatgacgttccagccggcggccggcgcccacggcgaattcacgggacttctgctgattcgtgcctggcacgagagccgcggggatgagaaacggacgaagatcattgttccggattccgcccatgggacgaatccggccagtgcaaccatggccggctacaaggtaatcaatattccatccacagccgacggacttgtggatttagagaagcttcggggggctgtcggggaagacacggcaggcctcatgctgacgaatcccaatacagtgggactctttgatcccaacattctggagatcacaaagatcgtccacgatgcaggcggcctctgctattacgacggagcgaacttaaatgcggttatgggaatcacacggccgggagacatgggcttcgacgtggttcatttgaatctgcacaagaccttttccacgcctcacggcggcggcggacccggaagcggtccggtgggctgcaagcgtttcctggaaccgttcctgccgggacagaaggtggtggaacgggacggcgtgcttcgcatggagccctatgaaaaatccatcggcatggttaaggaattctacggaaacttcctggtggtggtgaaggcgctctcttacgtgctgacgctgggccccgacggcattgccgacgcctgtaaaaacgcggtgttaaatgccaattacgtcagggtaaagctgtcagactattaccatatgccgtttaaacagacgtgcatgcatgagttcgtcatgagtctggagcaggaaaaggaagagatggacgtgacggccatggatatcgcaaaggcccttttagatcatggaatccatccgccgaccatgtacttcccgctgattgtccacgaggccctgatggtggagccgacggagacggaatcaaaggagaacttagatgaactgatcgccgtgttccacgagatctatgagacggcgaagcgtgatcccgaatatatccggagctccccccacatcaccatggtgaagcgcctggatgaagtaaatgcggcccggaatccgaagctgcattacgcattcggggaggaaagcgcagagggggaagaggcgtgatccgccgactgaccctggccctggggccggggtcatacccctatcccaatttcggcatggaggagtatttgctttacgatgtggaagaagaggaatgcattctctacctgtggcagaatgagaaaaccgtggtcataggcaggaatcagaacgcatggaaggagtgccgcagagaggaactggaggcggccggaggtcatctggtgagacggctgtcgggaggcggcgccgtattccacgacctgggcaatttaaattttaccttcatcacaagaaaagataactacgatgtcacaaaacagacggaggttatcctaagggcggtcaaaaagctgggtgtaaatgcagaacggaccggccgcaatgatatcacagtggatggccgcaagttttccggcaacgcgtactacgagaccggggacttctgctatcatcacgggaccattctgctctccgtggacaaagaagagatggcccgctatctaaacgtttccagggaaaaactgagatccaaaagcgtggattccgtcaaaagccgtgtggccaatttaatcgaattcgtaccggatctgacggttagacgcatgagagacagtctggaggaaagcttcggcgaggtctacggccttcccgcaggcccatttcctccggaacggctttgcgaagacgaggtaagggagcggacggagcggtttgcctcctgggagtggaaatacggcaggaagatcccgttcagcgatgaagccgccgcccgttttacctggggggaggcccaggtgctggtccatgtggaagaggggcgtgtccgggaaggaaagatctggtccgacgccctggatacggattttatcaaagctacggaagacattctgaccggcatgatctggaacagaaaggcagcggcagaccgttttgcagccctgtcctgcggcactccggttcaggaggcgatgcggcaggatttacaggatctggtctgcgatatgatgtagtgctgtgccgtcgattcacagacgcgcctgagagaacaggaggattggatggaaaaacattatgatctcgtcgtaatcggcgcggggccgggcggctatatgacggccctgtacgcgtcgaaggcgggaaaaagaacggccgtgatcgaacggtcccatgtggggggcacctgtttaaactgcggatgcattcctacgaaaacgtatctccacaccaccggcctttaccgggaggtgaagaagacagaggccgccggcctccatacggaaggcctgcgcgtatccatggaggaactgaagaaacgcaaagacgccgtggtggaagaattgcgcgccggcatcgagaagcagctggccgccgcaaaggtcgatctataccgcggtaccggcgtagtgtgcggagaacatttagtgaaagtgatgccgggtgaggaagaagtaaccgcagattatattctgctggcagcaggctcagagccttcatcccttcccattccgggcatggacttaccgggcgtgaaaaacagcacccagatgctggaggaggagtgtgttccggaccgtctcgtgatcattggcggcggagtcatcggaatggagtttgctactgtatataacgacctgggatgtcaggtcacggtactggaagccatggataagatcctgcccggcatggacaaggagatttcccagaatttaaagatgattatgaaaaaacgcggcgtagacattcataccggggctacggtttcctccgtcgaaaagatgggagacggaacgtatctatgccgctatacggaaaaagaaaaaaactgtgaagctccggccgcgctgattctgtcagccgtcggccgccgtcccttaagccgcggtctgttctcggaagacatgcaggaacgcatcgaaatggagcgaggccgagtcctggtaaacgagcgctatgaaacctcggtacccggcatttacgccattggagacctcatcggaggcgtctgccttgcccacgtggctgcggcagagggctgtcaggcagcttccgccatgttcccggagctgaagggaaaggatatgaccgtcattccatcctgcgtatacaccgatccggagatcgcctgcgcaggcctcaccgccgacgaggcaaaggccgccggcatcgataccgccacaggaaaatacatcatgtccgtaaatggtaagtccgtcctgtccatgcaggaccgcggtttcctgaaaatagtttccgaaaaggagaccggccgtatcctgggcgcccagctgatgtgcgccagggcaaccgatatgatcggcgaactggaactggccatttcaaagcgcttgacggccgaagatctggcggccgtcatcatgccccatccaaccttctgtgaagggatcggagaggctgcagaatcaatattgatgtaatatgaagtacaggcagagttattattacacaatccccacagtttatggtgaaactgtggggattgtaagattcatattacttttctgatatgtattttggggctgagttctccagttctttaaaatttaaacatcttctggacaaaggagcatcaggatatttatattttagattatagatatactgagcctttgaagataagtctaaagaatttattacatgtaattctctgtctaataaatctatatatttacttttttcttcttctgattgaaaagtcctgtatgtatctatttttcttttttcaaataaggaaaattcggactttggaataggaaacatataatttaaattgatgactgcgatcaatctgtttgaaattgcaggatcataaattttataaaaatctttttgttgtttcatatttttatgtcttgactgggcatgtgatatttgtgtgatataatacaaattgttcttttcaaacaatatgccaaaaaatggtttatatctgtcatcaccataatccgttctgggaattctgctttcactatttcttaaatagtctaaatacgattcatttacattgatccatctcatcttttgtgttctccaattaaaaaagaaccggtatcaagtaccggctctttttaatacgattttgataggcttcgtaaccgctattaatacagtgtttggtaggctctgtaaccactattaatacgattttggcaggcttcgtaaccaactgctttatagaatacaataaatattctatgtaaatattatataataattccctgcaaaatacaagcgaaactttagaaaaataaactttaaaattgtatttattatataatatcatatgctttatagaagtttttggctactgcgtttatctgcggcctgattcctgtatcggaacagagcagtccccgtttaccataggaacagaacgggaaacagaagccgctcgaacggggagctgctgctcagatgtctttgtgaagtgaagaactttaaatagagggtattaaagttactgaaaatatgatataatgtaacataactttgggtatttatttagaagaacaaatgtaacccctttcctctttgcagatggaaggcggaatcgacaaaaacaagtaaaaaacaggaaggatgtgacacatgaatatcagggaatccacggaatcctgggaagcagaagctttaagcccttacgcctcactcagcaggaattcgagaggaagggaaagggaggaagaaccgtgtgatatacggcccgtctatcagcgtgaccgggaccggattatccactgtaagacatttcgcaggctgaagcataagacgcaggtatttctggcaccggaaggcgaccactacaggacgcgccttacccataccctggaagtatctcagattgcaaggaccattgccagggcgctgcgcatgaacgaggatctgactgaggctatcgcgctggggcacgatctcgggcatacgcccttcggccattcaggggaagcggtcctgaacaagatctgttcggaaggctttgcccactaccggcagagcgtccgggttgtggaggtcctggaaaagaatggaagaggccttaatctaacctgggaagtgcgcgacggcatcctaaaccacagaacgagcggaagcccatcgacgctggaaggaaagattgtacggctttccgataagatcgcctacatcaatcacgatatcgatgatgcgatccgcgccaggatgtttgtggaggaagatctgccggagtgctatacggaggttctcgggcacagcgtgcgggaacgcctgaataacctgatccatgatattatccgaaacagctatgagaagccggagattatcatgtccccccacatggaggaagccatgcaggggcttcgcacctggatgtttgagaacgtataccggagcgacgtacccaaggcggaggaaggaaaggcgcagcatctcattgtgatgctatttaactattatatggagcatacggataagctcccggcggaataccactatctgatggatgtacgccacgaaaaccgtgaacgcgtggtatgcgattacatagcggggatgagcgacagctacgccatcgacaagttcgaggagctgttcgtcccaaaggcctggaaggatatctgacagttaagggaatcagggaggtgtgaaatatcatgcgatatccggaagaagtagtagaagaagtcagaatgaaaaacgatatcgtggatgtgatttcaggttacgtgaagctgcagaagaaggggagcaactactttggactctgcccgtttcacaatgagaaatcaccttccttttccgtgtcgccctccaaacagatgtattactgttttggctgcggcgccggaggcaatgtgattacgtttgtgatggaatatgagaattattcctttatggaagcgcttcagatgctggccgacagggccggcgtggcgctcccgaagcaggagtacagcaaggaagcaaaagaggccgcggatctgcggacggccctgctggagattaaccgcatggcggcaaattattactatttccagctcacgaatccgcagggcgaggtgggttaccggtatttgagggacaggcagctggccgacgataccatacgccacttcggactcggctttgccaataagaccagtgacgatctgtaccggtatttaagggcaaagggatacgacgacaagattttaaaggagaccggtctggtcaccatcgaggagcgcggagcccatgacaagttctggaaccgtgttatgttccccatcatggatgtgaacaaccgtgtcattggtttcggcggccgtgtgatgggcgcaggggaaccgaaatacttaaactctccggagacgaagctgtttgataagagccggaatctctacggcctcaactatgcaagactttccagggaaaaatacatattaatctgcgaaggctatatggatgtcatcgccatgcaccaggccggcttcaccaatgcggtggcgtcgctgggaacggcctttacgacgcagcatgcggcgctgttaaaacgctacacggataaggtggttttaacgtacgacagcgacggagcgggaacgaaggcggccctgagggcgattccgattctgcgcgacgtgggtatgtccatccgggtgctgaacatgcagccgcataaagaccccgacgagttcatcaagaacatgggggccgaagcgttccgtgaacggatcgagcaggcgagaaacagctttttatttgaaatcgatgttttaaagagaaactacgagatggatgaccccgaacagaagaccgagttctataaccaggtggcgaagaagctctgtgagtttccggaggccctggagcgggagaactatttagaggccgtgtcccgggaatttttcatcaattacgaagatttgaaacgtctggtaaaccgcatgggagcgagactgggtccggtggctccgcgggaggaagaagagaatactgcgggaaagaagaaaaaggacagggaagacggaagaaatcagtcccagaggcttctcctcacatggctgatcgagaatccgttcctgtttgacaagatagagggaatcatcactcccgatgattttattgaagatctgtaccatcaggtagccaagatggtatttgacggacacgccgccgggaatttgaatccggcagaaatcctgaatcattttattaacgatgaagaacagtaccgggtggttgcgggactttttaatgcgagcctgaaagaatccctggataatgaagaacagaagaaggcattttcagaaacgatcatgaaggtgaaaaagaacagcctcgattatgccagccgcaacgcagcggggatcgaggagctgcagagaatcataaaggagcaggcggcgctgaaagatctgcatatttcactggattagggtgaacactataggcaagctgtggaaggatggaagaacatgggcgagaatgttaagagaacggcagagaagctgtcatcatcaaagaaggtggacgaggccagggaggcagaactgagggccgcagaagaactggctgcatttgaggaaaagttaaatcagctgcttctgctggcgaaaaagaaaaagaatgttctggaaaatcaggaagtgctcgatttctttactggcactacgctggatgcagaccggctggaccagatctatgattttctggaaacgaataaagtggacgttcttcagatcaatgaagacgaggacctggagctggatcccgatttatttatcgaggaagagctggaggaagaggaagaaatcgatatggagcacatcgatctctctgttccggagggcgtcagcgttgaggaccctgtccgcatgtatttaaaggagatcggcaaggttccgcttttatccagtgatgatgagattgaactggccaagaagattgagcttggagatgaactggccaaggagaagctgacggaagccaacctaaggctggtcgtcagcattgccaaacggtatgtgggacgcggcatgcagttccttgatctgattcaggaggggaatttagggctcatcaaggcggtggaaaagttcgattacaggaagggctataaattcagtacttatgcgacctggtggattcgtcaggcgatcacgcgtgcgattgcagaccaggcccgtaccatccggattcccgttcatatggtggagaccattaaccgtctcgtacgggtttcaaggcagcttttgcaggagctgggcagggaaccgtcgccggaagaggttgctttgaaagtggacatgccggtggaacgggtgcgggagatcatgaaggtatcccaggagccggtatccttagagacgccgatcggtgaagaggaagacagccatttgggtgactttattcaggacgatcaggtggcggttccggcggacgcggctacctttaccatgcttcacgagcagcttatggaggtccttgacaccctgacagagagggagcagaaggtgcttcgcctgcggttcggcctcgacgacggaagaccgaggacgctggaagaggtgggcagggagtttaacgtgacgagagagcgaatccgtcagatcgaggccaaggccctgcggaagctccgccacccaagccggagcaaaaagctgaaagattatttagacgactgatattggagctgtatatatgaaattatcaaaacggttagaaacagttgcttcctttgttcccaaaggaagcaacattgctgatatagggacggaccacggttacgttcccatttacttagtcagggaaggtcaggcggagcacgcggtagccatggatgtgagaaaaggcccgctggaacgcgccagagcccacgtggaggaggctggactcggaagccgaatcgatgtgcgcttaagcgacggcctggcggggcttaaaacaggggaagcggactgcgtcgtgatcgcgggtatgggcggggaactgatcatacatgttctggaagaagggcgggatctgtgggagaccatcggatactgggtcctttccccgcagtcggaactcgataaagtgcgccgtttcctggaaaaagagtcattttccattgttcgggagactatgatgaaggaagatggaaaatactatacggtgatgggcgtgacacgggacggtatttcctgggattatacctccgagccgcattacctgtacggaggacggctgatccggcagaagagtcccgttcttgcagaatttcttaagaaggaacaggaacagctggaacagattctggatacactgaaggacagcgacacgccggcggccttcaagcgccgcggggagatggaagccatgctggcctggaacaaggaggcacaagatgaaatgcttggaactgatacagaagcttgagacactggcgccgtctggctgcgcctgtgattgggataatgtgggcctgctcgtcggatggaaggagcaggagattcacagaatcttaatcgcactggatgccacagatgaggtggtggaggaagccattcggatgcgggccgatcttctgctcacacaccacccgcttatttttaaaccgctaaaaaaggtcaatgatgatgatttcattgccctcagggtgatgagtttaatccagtacaatgtgaattattacgccatgcacaccaatttcgacgcggctcccggctgcatggcggatattgccgccgggcggctgggccttctggaaccggacgttctggaggtgatgggcaccatggagatcgacggaaagcctgttccatatggtatcggcaaggtaggagcgcttccttatgcgatgacattaaaggaactggccctgtttgtcaaggagcggttcggtctgccgtttattaccgtttacggggaacacgcggtgaaggagacggtaacgcgtgtggcgattgctcccggctccggaaagagctccattgcctacgcggaaaaggccggcgccgaagtcctgatcacaggcgatatcgggcatcatgaaggcatcgatgcggcggcgaatcatctggcaattctggatgccggacactatggactggagcatctgtttatcggatttatggcggattacctggaaagggagtatggagacagccttgagatccacaaaacagcggcggcatttcctgcagccgtgctctaatactgcagcaaggaggtatcagatggcattagtaacaatcggtgatgtaacaaaagaatatccgaacgggacgacgtacttggagattgcggaggaatatcagccgcagtacgaggacgacattctgcttgtgcggattaacggtaagcttcgggagcttcataaaaaggtaaagtttgactgcaggctggaatttttcacaggaagggaccagccgggaatccagacgtaccacagaagcgctacattcctgttgctgaaagcattttacgacgtggtgggagcggagaagatcgagaaggtcacagtggatttttccctcggaaaaggctactatatggaaccgcatggaagttttacgctgacagaagagctgattgaccgtgtgaaggcccggatgcatgagtacgtggaagagaagattcccatcatgaagcggagcgagaatacagacgatgcgattgaactgtttcacagacaccgtatgtatgataaggaacggctgttccgctaccgccgcgtctcccgcgtcaacatctacagcatcggcggtttcgaagattactactatggctatatggtgcagaataccggctatatcaagtattttgatctggttttatacgacgacggctttatgctgatgctccctcagaaggagaatcccaaggaggttcccatttttgaggcggagaagaaacagaagcttttccaagtgttaaaggaaagtgtgaaatggggcgagcgcctgaacgtctcccatgtcggggaactgaacgaggtaatcgcgaagggagacataagccggctgatcctgattcaggaggctctccaggaaaagaagattgcggagatcgcggagaaggtcacgtatgaacgggataaaaagttcgtcatgatcgcaggcccgtcatcttccggaaagacctccttttcccaccggctgtccatccagctgaaggcacaggggatgatcccccatccgatcggcgtggatgattactttgtcaaccgggcggacagtcctaagaatccggatggaagctataactacgaggtgctggagtgtctcgatgtagaacagtttaataaggatatgatggcccttctggccggagatactgtcgagatgccgcgctataatttcaagacagggatgcgggaataccacggagacatgttaaagctgggcagagacgacatcctggtaatcgagggaatccactgcttaaatgaccggctgtcctattcccttccggccgaaagcaaattccgcatttacgtcagtgcgctgacgcagctcaacgttgacgagcataaccggattcccaccacggactgccgcctgctgcggcgtatggtccgggatgccaggacgagaggcgcatctgctcaggatacgatccgtatgtggccgacggtgagacatggggaagagcagtatatcttcccgttccaggagtccgccgacatgatgtttaactccgccacggtatatgagctggcggttttaaagcagtatgcagaaccgcttctgtttggaatccccagggattcggaagagtatatggaagccaaacgtctgcttaagttcctggattatttcctgggcgtaaacagcgagactattcccaataactcgattatacgggaatttatcggaggaagctgcttccgtgtatgacagcagcctccgaatacaaaagaaaatggattgtaaagtgaggaagtaaacgtggaactggctgttattactgcggaaaagataagcgtcatgtttgtcatggcacttattgggatgatttgttaccggattggtctgataagcggacacaccaatgagaagctatcggatattctccttctattggtgtcgccgctgcttatttttacatcctatcagcaggccttcgatccggagaagctaaacgggctgctgaccgcgttctttatggcggcggtcagccacgcagtggccatcacgatcacgtcctttctggtgaaaaagggaagaacggactgggaggtcgaacggatatcctcgatctactccaactgcggttttatggggattccattggtgagcgcacttttcggagccgacggcgttttctatgcgaccgcctacataacggtgttcaacgttctggtatggacccacggagtcatcctgatgaccgggaaacaggattttaaatcatttttgacggcccttcgatcgccctgcatcgtggcagtggtggtggggctgttctgttaccttgcgcgcatccggtttcccgcggttattctggagccgcttacagcgattgccgatatgaatacgccgttggccatgctggtagccggtgtctccatcgcaggaagcgatatccgcgccctgctcatgaaggtgcagatctattacgtctgtgcgatccgtctgctcgtcataccggtcgcggtcctactgttgctgaaggctttccggctcgacgatatggtcacgacggtaattgttctggccacatcctgcccaactgccaccaccggtacacttttcgccctgaaattccaccggaattccggttacgcctctgagatattcggtttggccacggcaagctccatcgtgacgatcccggttatgatgcttttgtgcggtttgataaggatatagagaactggtctttacaaaatccaaaatctatggtaaactaacaacgttttgagtaagacaaatggccgcagctgtaatgccgaaaggctgcagatgaggaaagtccgggcttcacagggcaggatgccagataacgtctggcggaggcgactccagggaaagtgcaacagaaatataccgcaccggcatgccggtgtaagggtggaaaggtggtgtaagagaccaccgctctcctggtaacaggaggggtccatgtaaaccccattcgaagcaagaccgaacagagagcataaggcggcccgcctgctttcgggtaggttgcttgagcctgccggcgacggcaggcctagatagatggccattcaacgacataacccggcttatcgtcttactcaaaatatgaatgaaaaagccctctgccatgcgggcctgcattccgttttttgcaggtccatgcggcagaaggcttttttatttcacaggattttaatatttaaggtttataatagcactcagtaaatcctggaaggttgtgacaatattgaaacaaaagagaatgcataagaggcagatgctgatctgtctggcggttttggcggtgctgtcctggatgacgtttcacattctgttcaaggaccactcgccggaggcgctgtacgaagttttttccagggcagactggagatttgtggggcttggcgtggcctgtatggccgtctatctgatctgtgaggcggaaagcatcaggaccctgatgggggcgtttcagacgaaggttccgtttctgcggtcggccgggtattcgttcgccgatttttatttcagcgcgatcaccccgtctgcaaccgggggacagcccatgcagctttattatatgacgcgggacggctttggctttgcccagagttccttttccctccttacgctggccgcggtataccagctgatggttctggtgtacggcgtggtcatggtaatcgtgaagtatccgtatgtgcagacccagagccgtctgatcaagtggctgctcatattcggcatcgcagtgaacggtatctgttcccttggcatcctgctggtgattctaaagagggcgctggtggagcgcattgcaatgattggcattacgattgcggtgaaattgagaatcattaaggacagaaagaagatggagcggaaggcggagcacctgattgacgagtacagcaggggcggcgaatgctttcgcaagtatccgctggtcttcgtgaaagcggtaattttgacggcgctgaggctgacggcgctgtttatgatcccgtattttgcctgtctggctcttgggatcggagatgtggggccgtttgagtttctggcggtccaggcaattctaagcctggcggtaaccgcggttccgctgccgggatcagtcggcgcatcggagggcagcttcatgcttttatacagcggcatggtggcggcaggcaatgtatttcccatgatgatgctgagcaggggaatcagtttttacggctttctggccgtcagcggcgcggcgaccctgatccttcagttctggaaggcgggatacacaaaagaaaatacataatccatacagttggctgggacaggctccggccagctgcatttttttgtgtaatagaaaaacacatcttacaggcgaaaaaataccacttaccgcgtttggtgagacaaatcagaaggggtggtatacaatgacatcagaagggaggaagaatatgaaaattatcatcgaaccgggagacatggaagagccggaggtcatcatacgcggacgaagcggaagcgaggaagtcaggcagctgctggagcttttaggcggcgcgggaggtatttcccagataccgctgtatgcggaagagaaggaatactttttcaggccggaggagatcagttattttctcacggaaggcggaaaagtcagtgcatatctggaatccggagtctatgaggcaaaaggaaggctctatgagctggcccggcagcttcgtcacaggggatttattcagatcagcaaaagtaccgtgatcaacgcagctatggtcgcttttgtggaggtggagttcagcgggaattacaccgcatttttgaaagatggaaagacaaagctgctcatttccagaaactacatgaaggattttagaaaatatattatggagggaagataatatgaaacgattggaaggatttttaacgtatctgtttacaggaattggaatcggggccgttgtgtgtacggtgtccctggcagtcatgggcggcatggatggaacgcttaagcagattctcgcatggctggcggcgtccgcgctgtttacggtaatttcgcagattatgtgcatggattttggcaatctgctgatccgcaccataatccatttctgcctctgctttaccctggctgtaacggttggaacattccttaattattctgccgactggatttccagcgccagagtgatgctgcccgcgtttctcattatttacgtgattatctatgtggtgatatttatggtaaggctggccgagatgaaagaactgaataaaaaactgaacggataagtaaaacaggttttcaaaagtaaaaagaatcatgacggtgaaacgttcaaactgtcatgattcttttgcgtaattgataatttgacgaaaacgcagttatttggagtacttttcctcgcagtacatgcagcggtaggtctcggtctccgaatccgcaagatagaagatatgcggcagctcctgctcgatggaggtgatgcagcgcgggttcctgcagtggatcacattggtgatctttttcggaagcttcaaggtcctcttttccgcaatctgattgccgcggataatgttgacggtgatgttgtgatcgatgtagccgagaatgtcgagatcgatgtggtccagaccgccctcgatcttaatgatgtccttgcgtcccatcttgttgcttcttgcgttcttgataatcgctacctggcagtctaacttgtccagtcccaggttatagtagatgtccaggctcttgccggcctgaatatggtctaatacgatgccttcgtttaatccgctgatatttaacatggtttttctacctccagtaatgtcataataagggccatgcgcacgtatacgccgtactgggcctgtttaaagtaggcggctctcgggtcgttgtctacttctacggagatttcgttgaccctgggaagcgggtgaagaacgtacatgtcttccttggcaagcttcatcttgttcctatcgagaatgtagcagtctttcaaacgaatgtaatcttcctcgttgaagaaacgttccttctgtacgcgggtcatatagagaatgtcgagagaaggcatggcctcgtctaagctgtccatttccacaaattcgatgttgttcgcttttaaaacgtcttccctgatgtattccggtacacgcagctccggcggggaaatgaggacgaacttgatgttctcatagcgaaccagggcgttgatcagggagtgaacggtgcggccgaactttaaatcgccgcagagaccgatggtcaggtcatgaagacggccctttaaggaacggattgacagcaagtccgtgagtgtctgggtcgggtgctgatggccgccgtcaccggcgttgatgaccggaattccggaatgggtggcggcaactaacggagcgccctccttcggatgtctcatggcgcagatatcggcgtagcaggagatgacgcggatcgtatcagccacgctctcgccttttgctgccgagctggaatcggcagaagaaaagccgagtacgctgccacctaaatttaacatggctgcttcaaaactcaaacgagttcttgtacttggctcataaaataatgtcgctaattttttaccatcacatacgtgggaatattccgaaaggtgatgttcaatgttgtctgccagatcgagcagctgaccggtttcttccacactaaagtctaatgggtttaataaatgtctcataagaatctcctttatccaatgtcttatacaatccgcattttgaatgggaatcaaaatgacagggcagcagtgctgctgaattctttacccattatatagtatcttataaaatatttccatagttttttgtaaaaaaagtgcctgtaaggaatatttaaggaactttaagaaaattaaggaagaccggatggaaaacctgttgtataatggcagtatgagaaaagaagggcgctaagtgctcatagcgaggaggtatctgctttggcggaagaaaacagggaagagaagagtaagaagatacctatgattcaggtaaaaaatctctacaaagtatataaagtcggcgacaccaaggtctatgccttgggaggggtcgactttacgatatataaaggagaattttgtgcgattgtcggtccctccggttccggaaagtccactcttctgaacatgatggccggattggagaagccctcgaagggggagattctcattgccgggaagcatattgagaagctgacggagaaccagctggtcgccttccggcggaagcatgtgggcttcatctttcagtcctataatctgcttcagacgatgaacgccgtggagaatgtggctctgccgctctctttccggggagtcccgaggaagaagcggaacgagaaggcagtgaagtatattaagctggtcggcctggagaagcagatgaagcacatggctaacgagatgtccggcggacagcagcagcgagtgggaatcgccagggccctggccgtggacccgcagatcatattcgcggatgagcctaccggtaatctggattcgaagacgacgaaggagattctggggctgatgagaaagattgtgcgggagcagaatcagacgcttgtcatggtaacccatgataattatattgccggctttgccgaccggcagttacatattgtagacggcaagatcttcaagatcgaagaacaacaccatgatgataccgaggaggatacagagaatgaagaagagaggtaatagggtactggcgggtctgcttgccgtactggtagtgctgggggctgtgccgcttcagtcgatgggggcgcagtacgggatacagaagaataagtatctcgatgtcaagaagactccgaccggaaagaccggtcagaatatgaccatcagcatgatatttgacaacagcaagggaagcgaggatttacagggagtgtccgtgcggtttgacgacagcgcagtggacagcgaatacgacgcggcggaagatccggatgaggacactaagtataatggttccgtgttcccgtttgagattacctccagcatctttgatgccaaggtgattggctctgtaaaggcaggcgctaccagaaccgtttctttatctgccagggtcagaagagatattgccgagggctactattccgtaccgatcatcgtcaaggccaacggcagcgacgctacgaccgaccacatcaacgtctggatcacaaagtccagcgggaccacggaatcgggagacgacgacggatcgatccgttttgagctgggggaaaaccagtccaccccatccggccagtatccggatgtgatgaattttaccgtaaacttacgcaacgcatcgaatattacggcatttgatgtcaatgttcgcatgggattaagcgaagacagcacaaaattcccctttaacatcaatgacggaaactacgtgagacattttgaccgggtcggcggcggtgagagccaggaggtatcctacagtatggctatccgcaaggagtcgtacaccggatactatccgatcacctttacgatcgaatacagagacagcaccgagggcgatattcagaaagcggaatccatcttctacgtacacgttcagaacaaggacaaggaagaggagacgggagagtttaacgccaacgacagaacgaaggccagactgatcgtcgacggattccagacgattccggaggtggtttacgcaggcgatgatttcgacctgattctccgcatgaagaacgcatccgagaacgtggctgccagcaacatcttatttaccctggaatccgagaaggtgacggacagcgcggtatttaccacagactccggctcctcctccatcgtggtgaattccctggcggcaggacagagcacagagcttaagatacgcatgaaggcgggggcctgggtggatcagagaacctacgccattacgatcaatgagaaatacgacagcccggaattcaagaacgccgaggagaaagtaacggtggacattccggtgaagcagatggcacggcttaacaccggcaccatcgatatcatgccggactccatctctgtcggagcggaatccaatgtcatgttccagatcaacaacacaggcaaagtccttctctataacgtgatggtcaccttcttaggcgattccgtccagaagacagacgcctatgtgggcaatatcaagccgggagactccggcagcgtggacgccatgctgtccggcatcgcccccactgcggatgacggcaagatcaagattatgatcacctatgaggatgagaacggagtagtcagcgatccgatcgaaaaagagatgacgctgatggtaactgaggctgtggatcaggacttcgatatgacggatgacatgggtacgtttccggcggatgcggaaccgacgggcattaagaaataccagaagttcataattccagcggtaatcgtagtgcttgtggccggcaccgcggcaggcattatccttgttaagagacggaaaaagaagaaggcagcagaggaagaggaaatagacgatgagatttagtgatttgctttccatgagtgtgaacaatttaagacgaagaaagctcaggacattcctgaccgttctgggggttgtaatcggtacagcctccatcgtggtcatggtctctttgggtatcggtttaaatgaactcaccatggagcagattgcctcctacggcagcctgacggagatatccatctattctgacgccatgtggggaggttccgatgacggaaaggatccgaagtatatgacggatgaggtcatggaccagtttcgcaggctggaccacgtgactacagtctcgccgatcctgtcgacgtacgttatcatgcgtcagggtgtttaccaggcgaatgtcaaccttaccggtgtgacaaaggaatatatggaaaagatccccttaaaggaggggactgtgccggataccagcggcaatgagcttcagatggtggtcggcaacatggtgcccagacagttttataatccgaagtccaggagcaaccggtacggcatgagcggagacgacgtcccggatatcgacttcatgaataagccgattttcgtgattttcgatacggatgcctattatcagagccagaacggaagcacgacggagggaggaactccggtcaaggctcccaagaagtatttgctgccgacctcgggcctggtggaaggcggactggaggactggaacaactacagctacagtgtgtatgtggacatcgacatgctgaaatcccagctaaagcaggtatttaagaagaaaccgattccaaaccagccgacgaataagaaggggaagccctttaattacttcgtctacgagcaggcggtggtggaagtggatgatatgaagaacgtcaccgaggtgcagaagatcatcaacgacatgggattccaggccaacagcaacatggactggctggaacagtcccagaagcagtccaacatggtgcaggccgtgctgggcggcatcggcgccgtgtccctgttcgtagcggccatcggcattgccaataccatgatgatgtcgatctatgagcgtacgaaggagatcggtattatcaaggtcctcggatgcgatatgggcaatatcaggaacatgttcctgctggaatccggttttatcggtttcatgggaggtgtgatcggaattgtcttaagctatggaatctcctttattgccaataagtttttatccggccagtttctggtgggcatagaaggagatttatcgagaattccaccgtggctttcggtatcggcagtgggatttgccatattcgtcggtatggcggcaggcttcttcccttcgctgagagccatgaagctaagcccgcttgcggcaatccggaacgagtaggaagtacgggaaaaaatacttgcatttcagaccggaatattatatgatatgtgacagagtgacgtgcgactggcggataagtggagagataccacggggagcacgttcgataagaagccgaccgcctgggcaccgcttttggggtatccaggcggttttttattacttaggaaagtttgtcctatgatttcggacgataccactatttaggaggaaagaagatgaacatgatttcactgaaggacgatttgagaggcaattcctatccgggaagagggattatcatcggaaggacaccggctggaacaaaggcggtggccgcttactttattatgggaagaagcgagaacagccgcaaccgtgtattcgtggaggacggggagggaatccgtacccaggcattcgatccggcgaggcttaccgatcccagcctgatcatctacgcacctgtccgtgttcttgggaacaagacgatcgtaaccaacggagaccagacagatacgatctatgagggcatggataagcagatgacattcgagcagtccttaagaagccgtgagtttgagccggacagccccaactatacgccccggatctctggaattatgcatgtgaagggctgtacggactgtgatgtccaggaaaagggccattataattatgccatgtccatcttaaagagcagcaacggaaatcctgattcctgctgccgctatacatttgcctacgagaatcctgctgccggagagggccatttcatccatacgtatatgcatgacggcaatccgcttccaagctttgaaggcgagcccaaacgggtggaaaccatggacgacatcgacgcgttcaccagcctgctgtgggagaatctaaacgaggacaacagggtatccctgtttgtacggtatattacgattgccacaggtgcgtatgagacacgcattgtgaataaaaaccagtaattctttatacaaaaggagaaaaagcgatgaacgaattagaactgaagtatggctgcaacccaaatcagaaaccatccagaatcttcgtgaagaacggagatctgccgatcgaggtgctgagcggccgtccgggctatattaatttcatggatgccttcaacggctggcagctggtaaaagaactgaaagaggcgataggacttccggcagcggcttcctttaagcatgtgtctccggcgggagcggccgtgggccttccgctggacgagacgttaagaaagatttactgggtggacgatatgggagagctctcgcccttagccagcgcctatgccagagcgagaggtgcggaccgcatgtcttccttcggtgatttcatctccctgtccgacgtctgcgatgcggatacggccaggatcatcaagcgggaagtctccgacggcgtcatcgctcccggatatgagccggaggcactggagatcttaaagtccaagaagaacggcaattacaatgtcatcgctatcgatcccgcgtacagaccggaaccgatcgagcgcaagcaggtgtacggcattgtatttgagcagggaagaaatgaactgaagatcgatgaggaactgttaaaagaagtcgtgacttccaataaagagattccggattccgcgaagattgatctgatcatctccctgatcaccttaaaatatacccagtccaactctgtctgcttcgcaaagggcggccaggccatcggcatcggtgcaggacagcagtcccgcgttcactgtacgagactggcaggaaacaaggcggataactggttcctgcgtcagtgcccgaaggtcttaaatctctcctttgtcgacaacatccgccgcgcagaccgcgacaatgcgattgatgtctacatcggcgaggactatatggatgtgcttgcagacggcagatgggagagtattttcaaggaaaaaccagaggtatttacaaaagaggagaagagagcgtggctggaccagatgacggatgtggccctcggctctgatgcgttcttccccttcggtgacaacattgaccgggcgtataagagcggcgtgaagtatgtggctcagccgggcggatctgtccgtgacgatcaggtgattgagacgtgtgacaaatacggcatggcgatggcatttaccggtatccgtctgttccaccactaagactctgcgttttagcggagacaaaggaagacaaaagaaaagacaaaaaaacgaggcaaagtattgacaaaccgaagatatttgataaaatattagtggttcatcggagggatataaatcgtttgaattttatatgccggataagatgtcaggtggaaatcctgatattttatccggcttttttacgtagtaaagaaagctcaggaggtacctttatatgaattcaaccactcaaaacacactgacagagggaaaactggccccggcgcttctgcgctttgccgttccatttctcatctcaaactttcttcaggcgttatatggagccgtcgatttatttgtcgtgggacagttttcgacttccgcgtccgtatccgccgtggcgatcggcagccaggtgatgcagacggtcacctggatcatcctgggaatatccatgggcgggaccgtactgatcggtcagaagatcggagagaagaacgaggaaggcgcggcggaggctgtaggctgcgtcgccgtcttattcggcctgatggcccttgtcttaaccccgctgatgctgattgccgttaatggggctgtagccctgatgaaaaccccgccggaggcggtcagcgctgcgcgcagctatatcttcatctgttcctgcggacttccgtttatcaccggatataacggcgtcagcggtattttccgcgggatcggggattcacggactccggtaatcttcatcggcctggcctgcatcgtcaatgtcatcggcgatttcctgttcaccggctggatgggcatgggcgcagccggagcggccttcgccacggttatcgcccaggcagtcagctttctggcggctctggcatatatgtataaaaaaggattttccttcccctttggacggcgtcacttaagactccgcaggaaaccggccgcggctatcctgaaggtaggatttccgcttgccctgcaggacgcgctggtcaacgtctcattcctgattatcacaacgatcatcaacaccatgggactgaccgcgtccgccgccgtgggagtcgtggagaagatcatctcctttgccatgctgcctccaagcgccatcgcatcggcagtgaccacggtgactgcgcagaacatcggggcgaagaagccggagcgggcgaagcgggcgctctggtacgggatcggcttttccctgatctttgggatcgcagtctgtattttcgtccagttttttgcgccgctggtcactgcggtattctccagggacgaggctgtcatactggcggcggcccagtacctccggtcgtactcctatgactgcatcctggtcagcttcgtgttctgcatcaactcgtatttcagcggcaggagcaacgcgctggtcccgtttatccacagcatgatcgctacctttcttgtccggattccggcgacctacggcttcagcctgatcgcaggggacagcttattccccatgggacttgccgcgccgctggcttccgtcgtgtccatcgtcatctgtttcggctatatgaggtgggaagagacgcgaaaaaggtaaaaacgagggaaaataaaaagaagtataagcctatattttttgtaaaagcactttaaaaggaaagacggcataaaatgagagtaagtaagttttaaggcggctttctttgaaaacttttcccaaacctttaactgcgcgagaggaacgagagtgtctggaacgataccaggaaggggatcaggaggcgagagccacactcatcgagcggaatatgcgtctggtagcgcatgtggccaagaagtatcagaatacggattatgatatggaggacctcctgtctgtcggaaccatcggtctgatcaaggccgtcaatacgtttcacacggacagggggtcaagactcgccacctacgccgcgaagtgtgtggaaaatgaaatcctcatgctccttcgtgctaataaaaaatattcaaaagaggtgtctttatttgagcccatcggagtagacaaggatggtgagactgtcagcctggtggatgtcatagagatggagaacaaggaggctctggagaccatcatcctgagccaggacatcaaggaactgtacgatgcgtttgaccactgtctcagagacacggaaaaaaaggtgatcggcatgcggtacggactatacggaggaaaggagcacacccagcgggagatcgctgatatgttaggaatatccagatcctatgtcagccggatcgagaagaaatccattgaaaaattacgtatggaattcgagaaaaacaataaaaaatcaggaattattaaataagtataaaaaatgtctaaataatttgttgactttttcctagagttctggtatagtatgaattaagttaatacgagatggattgttactggtaagcaggcaaaaccaattttgatcaatgaaaatataattttattttcgctggcaaaattggtttttttatttgtaggtgaagtatgaaaattgacaagattatcaacaataacattgtcagtgccatagaagcggatggaaaagaagtcgttatcatgggccggggactgggatttggaatgaagcccggaaaagagattccggagggaaagatcgagaaggtcttccggttagacagccagaacagcacggataagtttaaagagctgttggcgaatctgcctctggagcacattcaggcatccacggagatcatcaattatgcgaaaagcgtgttgaaccggcgtttgaaccaaagcatctatattacactgacagatcatattaattttgccatcgaacgatttaaagagaagatgatgtttaccaatccgctgttaaacgagatcaagacgttctacaaggaagagtacttaatcggcgagtacgccgtggccctgattgagcgaaggattggaattacacttccggtggacgaggcgggatttatcgcacttcatatagtaaatgcggaatataatacagccatgcgggacacgattgatattacaactttaattcagaatgttgtaaaaatcgtgaaagaatatttttccatggatttagatgaaacttcgctgaattaccagcgttttgtcacgcatcttcgtttcctggctcagcggattatcggaggagagatgctaaacagtgataatccggaattcaaccagctgatcagtcagatgtatccggaagaatacgcatgcagtctgaagctgaaggattatatccaggtgacctaccaccatgatgtgaccgaggaagaaacggcatatctggctgtccatattaagagaataagaatttaaggagaagaaaggagattgaggaaacatgtttagttcattgaaaaagatgttttcaggaggcgagaaggagagagagaagatccttgcgccggtagaaggaaaggcggtaccgttaagcgaggtcagcgacccgaccttcagtcaggaaatactgggaaagggtgttgccatcattccggaaaagggaagaattgtggctccggccagcggtgttctgaccgttatgtttgagacaaagcacgcagtcagcgtaacgactgacggaggcgctgagatcatcgtccatgtgggccttgataccgtaaatttaaagggagagcactatacctcctataagaagcagggcgagcatgtcaaggcgggagagctccttgtggagtttgacatcgacgcgatcaaggaagctggctacgatgtgattacaccaatcatcgtatgcaacacgccgaattatccggatatggtatgccataccggcatgcaggttaaggaactggatccgattatcgaattatagggctggagatctatgagggagttcttatatgaagtgaaagaccctatgggctttcacgcaaggccggcttcacggctgttcatgaaggcgagagaatacgaatgccggattgacgttgccgcggaaggggaaacggtggatggaaagaatcttctggctctgatgagtctcgagatcagagaaggagagatgcttcggttccggttcgagggaaccgatgaggaagaggcggagaaagcacttttagaggtgctggaccagatatgatttgaacctgtgatgggcacaggatcagataaataatgtccgttaggacaaaaaagaaaggggtttctttattatgatgaagtatttgcaaagacttggtaaatcattgatgctccccgtagcgtgtttacctgcagctggtatcctgatgggtattggttactggattgacccgaatgtaatgtcgggactcggtacgccaagcgcgctttcgttcttccttgtgaaggcaggcggtgcgctgattgacaacatggcgattctgttcgcaatcggtgttgcaatcggaatggctgatgacaacgatggtacagcggctttagccggtattgtatcatggctgatgattcagcagattctttcacctgcagtagtaggttccttaaagggaattgatgtatcagaagtaaatgcagcattctcaaaaatcaacaatcaggctatcggtatcttaagtggtttgattggcgctacctgctataatcgcttcaagaacacgaagcttccggatgcacttgcattcttcagcggtaaacgcagtgttgcaattgtaacggctttggtatcgatcgttgcttctctgattctgttctttatctggccaattgtttattccgcactggtagcttttggcgagtcgatcatcggtttaggcccgatcggcgctggtatttacggcttcttcaacagactgctgattccgctcggattacatcatgcgctgaattccgtattctggtttgacgttgctggtattaacgatctgttcaagttctggggaaccgtcgatggtgcggtttacggacagacaggtatgtacatgtctggtttcttcccagtcatgatgtttggtttaccggctgcagctcttgccatgtatcagacagcaaaaccgggtaagaagaaaaatgcttatggtttattattcgcagcagcactttgttccttctttacaggtgttacagaacctctggaattcgcattcatgttccttgcaccaggattatacttaatccatgctgtattaacaggtatttcactggcagtcacagctttacttccagtccgttccggtttctggttcagcgcaggtttcgttgactggttactgagcatgaaggctccaatggctgagaatccattgtttatgcttccgttaggtttagtttacggtttgatttactatgtggtattccgttttgccatcgttaaattcaactttaagactcctggccgtgaagatgatgatgagcttgacatggatgagtcaaaagttacattagccaacaatgattttacccagatcgctacaatcattctggaaggtcttggcggcaaagagaacgtaacaagtgtagataactgcattaccagattaagactggaaatcaaggactacacaaaggttagcgagaagaagattaaatctgcaggtgttgcaggcgtaatcagaccaggtaagaccagcgtacaggttattgttggtcctcaggtacagttcgtagctgacgaattcaagaaactgtgtaagtaattacgatagagagacagccgggcgggtgaccgttccggctgttttactatttcataggaaagttcgtcctgggccgctgaagtgactgcgctccggcgcgagagtccgtcttgccgaactctttattctaccaaaaaggggattctcaggaggtttgccaaaaataaatgttaattttatgtgaaaaggctgaacgaaaggtaaattttgtggtagaataggaaaagaaaacagaacagcaaaggaaatgtgcagacatgagagagaaaaaagaaaagttacaggaacaggaagagccgtttgatctgaaaaaagaaatatttgaatgggtgaagatcatcattgcagctgcggcgatcgcgttcttcctcaacaccttcattatagcgaacagcacggtgccatccggttccatggaaacgacgatcatgacaggagaccggattatcggttccaggctggcctataagctcggcggagatcctgagcggggagatatcgttattttcgatcatgagacaggacccggcaacgaggaaacacgcctggtgaagcgggtcatcggtctgcccggagagacggtggagatcagggacaatcagctgtacattgacggaaccctgcaggacgagccgtatttgcgggaggcgatggattccgacgattatcattttgaagtgccggaggactgttacctgatgctgggagacaaccggaattactccgcagacgcgagatactggccggatccctatgtgccggagaagaagatactggcaaaggttctcttccgttactatcccagaattggaaaaattaaataatttttagaaatcacttgaccttccagttgctggaaggtctattttatgtaatagaatagagcattattaatgttacagagactgggaggaactggaagatgaaacaggagaataatctgacggaaggaaatgtgttccgggttttgctggaattttcgattccgtttgtgattgcaaatgtgattcaggcgctgtatggggccgtggatctgcttgtgatcggcaaatactgtacgccggagagcgtcgccgcggtttccacgggaacgcaggtgacacagatcatcaccagcatgattacgggacttacgctcggcggaaccatcatggtgggaaagtatacggggatgaatgcgaaggaggaggtgaaggagaccatcgggacgacgctgtccatattcggggcggcggcggtcgtactgacggtcctgatgctcttttttactccggctatcttaaggctgttgaaaacgcctgaggagtcgtttgaactggcaaagctgtatgtgatcatatgcagctgcggaatcctctttatctgcggctataacgccatcagcgcgatcctgcggggatatggggactccaaacggcccatgatgtttatcgctctggcctgcgtgttaaacatcgtgggcgacgtggtactcacaggcatcctcggcatgggggtggcgggagtcgccattgcaactatcggatcccaggcggtcagcatgatctgtgcgatctggtacttaaaccggaatcagtttatctttaccttccggtttgccaatctgaaaatcgaccgggataaggcgctggagctggctaaggtggggattcctatctccctgcaggaatgcatggtgcggctctccttcctctatctgaccagtgtgacgaaccggctgggcgtctatgcggcggcggccgtgggcgtggcaagcaagtatgatgtgtttgccatgctgccggccacctccatcgccaacgcgctggcggccatcaccgctcagaattacggggcgggtaagccggagcgggcaaagcgttcccttgcggcagggcttgcctttgcggtggcggcttccgcagtgttctggctgtgggctcaggtgtctccgcagaccatgatcgggattttctcagataaccaggatatcatagcggcggggattccgtttttcacatcgtgcagctatgactatctggcagtcagcttcgtgttctgtttaaacggctatttaaatggcaggtcgaagaccattttcaccatgatcagctgttgcttcggagccctggctctgcgtatgcctctgatctggctggtctacagccactggccggataatctgttccgcatcggaaccatcgccccgctggtgtccggatttatggcctgttatacacttatttacgtaatctatggcttttggaaggagagaaacgcaggaagggtttccaaaaccggttaagcggaatatattactagaaaaagcaaagacagatgactatgtttcatatcctggttttagtcctggccctctgcatggacacctttgtggccagcatggcctatggcgcaaataaagtgcatattacatgggaaaaaatcgttgtcatgaatgcaatctgcagcggttgtctggggattgcgctggtggcgggaagtgtactggacggtctggttccggagagcatgacccggacggtgtgttttatcagccttttccttctcggcgtggtaaagcttctcgattataccattaagaaatacattaacaggcacgtaagcctgcataagggaatcacattttctttctccggccttcgtatcattgtcaatatctacggagatcccatggcggcggactgggaccattcccagtcgctgtcatggaaggaggttctgtttctgtccttcgccatgtcgatcgacagcctgatcgcgggggcactctccgcatttctggaaataccggtgggactgacgatggggacggcgctcatcatgggaatcgtgatgatgtatgcgggcctttttttaggaagaaagctggcttcccgctgcaaatgcgacctctcctggatcagcggcgtcctgttcatgattctggccgtgacaaaaagcctttcatgagttatactatgagcacctggtgggggttctgaataatcaggtgacaggagataagagaaatgaagataacagtaccacattattacagccggtttcagtgcgtggcgggcgaatgtccggatacgtgctgcgccggctggcagattatgatcgatgacgcatcgttaaaaaaatacaggaaaagaagagatcccttcggcagccggctgaagaattccattgactgggagaattctgcgttccgccagtatgacgggcgctgtgcatttctagatgaaaataatctctgcgacatctattcggaggcggggccttccatgctctgccggacgtgccgggcgtatcccaggcatatcgaggagtttgagggggtgagggagatctctctgtcgctgtcgtgcccggaggctgcaaagctgattctggactgcgaggagccggtgcggttcctgagtaaagagacagagaaggaggagacttacccttattttgatttctttctttatacgaagctcatggactgcagagatttcatcatttccacgctgcagaaccgggagctggactggaacctgcgcacgggaatcgtgctggggctggctcatgacttacagcgcagaatcgtgaatgaccgtctgtatgagacggattccctgctggagcgttacggaaggaagggggctgtcgggaagctggcctccaggcttttggcgtatcagattgacggggagagccgttttgacgggatgaaagaactgttcggtttctttgacgagctggaggtgttaaacgtcggctggccggattatatcgggcggatcaggaaggttctgtacggcgcaggggaaagtgcgtatgaggagcagagacaggaattttatgaattcttagaggtgtcggagaagcggcgtgagacatgggagcggtggtctgagcagctgatggtctactttgtgtttacctggttctgcggtgcggaatacgatgaacgcccttatgagaagatgaagctggccgtggtgagtacgctcctgatccgtgagacggcgcaggccctgtggaaagagcagggcggcgtactggataagaatgtgttttttgaggccgcgcgccgctattcaagagaggtggaacactctgatctaaacctggaacgcctggagaatctgttccgtgaggagaaggtctgcggcctggaccggctgcttacgctggtcatggggtaaaattaaaagaaagagcagaaccggacacgaaattgttttgcgttttacaaccatacacgactgtgatagaataaaagaaaaaagctaccggaggtacaaaaccatgtcattggaaggcaagatgaagagtggccgcttatactgcgaattcggccacgagttggaagagaacaaggcatatgagcagaagatccaaaaccagcgcgtgcattgtaaggagctggtctatgattataatcagacaagaccgtcgaatggaaaggaaaaacgtaggattttagacgaactcctggcggaagcaggagaggaaatctggattgaatcccccgcctttttttcgtacggatgcaatacgcatatcggtcatcacttttattccaattttaatatgtgtgtcgtcgatgactgtgaagtatttatcggcaactacgtgatgtttggaccgaatgtgacgcttacggtcacgggacatcctgtctggggagagtaccgccgcaagggcgctcagttttccctgcctatccacatcggggacgatgtatgggtcggatcgaatacgattattctgccgggtgtgacgatcggaaacgatgtggtgatcggagccggcagtgtggtaacccacgatattccttcccattcggtggccttcgggacgccgtgcagagtggtgcgggagattacggaggaagaccgtctgtcttaccggaagggctatccggttaatgaggactgggacagagactagagactgaaaaaacagattaaagttacaaaaaaactgctgaaaagtcataaaatgacaaaatggttacatatttaaaaaaataactggaaaagtctgtcataaaaatgtaatatatcgtaatgataaagaaattgaaagatattggttgttttactataatgaagatagaaaataactggtgcatttttatgaggaggatttgatatgaaaggaaagcggttagggtttattatgacactggtcctgatcatggcgctggccatgccggcatgggccgcagatacgaagattgattcggtgaagctggacttctcgtactcgggggaggaaccgaagtccggcaatgagatcggccgaattcacgtgaaggcgtcggatggacagccatttaccgttgaatacgcggagtattcaaacgaaggcgacgtctgggtggttggcgaccggccgctggttcatgtagaactgacggcgaagagcggataccgtttcagctccacatcgaagagcagatttacgttaaacggatgcagcgccgtctataagaaggccagaatctacgacgacgggacacagatggaactggaggtatatttaaagagaatcggcggaaccttaagcagcgttcagaacctggagtggggtggaaacgtggcttactgggatccgctggaaggctcgaaggaatacgaggtccgtctttaccgcgacgagaaatcggtagtgaccgtcaagacaacagacagcagctataatttcgcaaacaatatggaccgtgagggttcctataccttccgtgtccgcgccattgcaagctataattccagagcaggcgagtggtccgactattcggaggattactacattgacgaggatgaggtctggtactacggcggaaacggagcatggcagcagaacgccagaggctggtggtacgcatattcaggcggcggatatccgagaagctgctggaagctgatagacaacgcatggtattatttcgacggtgacggatatatgacgacaggctggagacggatcgacggcaataactactatctgggacctgacggcaagatgcgcaccggatggcagcagatcgacggggcatggtactacctggacggaagcggcgtgagaacgacggactggcagtatgtgaacggacgctggtactacatgaattccagcggcgtgatgcaggtcggatggcagagaatcaacggcgactggtattatctggatggaagcggagccatgatgacgggctggcagtatattaacggagcctggtactatatggacggaagcggcgtgatgtacgcgggacgctggactccggatggtagatatgtggattataatggagtctgggtacagcagtgatgcagataaatgggtacagtggagctttccgctgtacccatttttggctctttttcaagctcagattaatagtggttgtttcaatccacgctcgataatttcacagagtgcgactacatcttatagatgcgcggcttgacttcatgtcagtgggggataccgatttctctccgcccgccactgccgttaagcttgttttcggcgtttcatccctccacctatagaggcgggggaattctcgcttgttttgttaaataaaattcgcaaataccgatgcgaacaacaccgtgcaaagcccggacacggcgatggcgaggctgctcatggctccttcgatctcgcccatttccatggcttttgtggtgccgatggcgtgggatgcagaaccgatggcgatcccctttgcaaccggctctgtgatgtggaaaagacggcagacggtctccgcgatgatgttgccgatgatccccgtgatgatgatgcaggccacggtaatcgtgacaatgccgcccatctcctctgatacgcccatgccgatggcggtggtgatggacttgggaagaaaggtgacatactgttcgtgagtcagctggaagagtagcgcaaggaccagaaccgtcgccatcgtggtcagaacaccggtcacggttcccgccagaatggccctggcatgctttttcagcaggcttagctgctgatagagcgggacggccagacagacggtggcgggagtcagcagatagcttaagtatctggcacttacattatagctttcatagtcaatgttgaaaacggataaaaatatcatgactgcgataatggatatcaacagtggattgaaaatcggaagtctgaacttcgccttgagaaagaggcccagttcatatcccatgatgcttacagctgctccaaaaaatagaaactcttttatcatctcattcatgttccggtaccttcttctttttgtcagatcttataaaaaactgcgtaattttccctgaggcgaccataaccaccactgtggagaccatggtgatgaccagaaaagggatgaggatcggccggagcagtccccaggaatcgagaagtcccactgcggcaggtatgaacatcagcggcataatgtcgattaagaagtaactggcttcctggacgctgtccagaggtatgagcttcgtctgaagccccgcgagcataataagcagcccgtagatgctggctggaactggcagaggaataaagtagtgaagcgcttccccaatcagggaaattatcaggatgatactgaattgtttgatgaatttcatgtcttttgcctccctttatgtatcattcgtttaactacggtttatcctaaactcaaataagccgcttgtcaaatattttttcaactgttataatacccattacaccgaaaaaaaacagattcataccggaaggagcttataaatcatgatagaagcggagtttggaattctttattttctgcagtccatccatacaccatggctggatgtggtgatgaaaaatattacccatctgggggacagcggaattttttggattctcacgggacttgtgctgttctgttttaaaaagacgaggaggatgggattctgcgttcttttatccctggcaggcggtttactgatcggcaatattctcttaaagaatttagtggcgagagaccggccgtgctggatcgatcctgccgtacagctgctgatcgaaaatccgggggatttttccttcccttccggccataccatggcctccttcgaggcggctgtgagcatctttctctataaccggcgctggggagtggcggcgctcgttctggcggcgctcattgcattttccaggctgtatctcttcgttcattttccgtcggatgttctgaccggactcgtgctgggagtcgtgatcgcgctggcagtccataagggcgtggaatggctggtaagacaaaagaaagaaaagaatggagatgccgaatgaaaaaatatttgcattttccgtattctgtgatatactgagttcgttacaaattacaaatcaatattagcagagtaggtttgtgtgcgttaagtgctggttgaacagggagttgtcagccggacgaaaagatttttcttgcggtacacgaatcgcatcccgctgcatcagaagatgatacgtttattatctccggttgtagtaagaggtctgcaaaggaggtatttttttatgaaaaaattcgtcactttgttcaccgattcttacaaagaactgaaatctgtaaggaccatcaccaccgcggctatgctcgcggccatcgccatcattctgggcatgttttccatcaatgttggcagtaccatccgaatcggcttttccggtattccaaacggcgtatgcgcctatttattcggacctgtggtaggcggaatcttcgccggaggtctggatgtgctcaagtatctgctgaagcctgccggaccatttttcccggggcttacggctgtcgtcgtactggcgggcgtgctctatggctgcttctactataagaagcccatcaccttctggagggtgctgttagccaagtttgtagtcatgctgatctgcaacgtgatcttaaacaccctgtgtctgtccgtcctgtacggcaagggctttatggtgatcctgccggccagagtgatcaagaacctgattatgtggcccattgattccatgatcttttacagtgttttgaaggcactaaacctgcttgggattttaaaggcggtccgtacgaatttcgcgtaattttaacggctgctcccggcagtggattctgataaaaagttccaggccgcctgacggatgagctccatcttccgccgggtggcctcgttgctgtatggaacccggtcgatgagcttatcgatggtgccgcgaccggccacaatacggcggctttccggaaagtttaagtcatagatatagccgaggtaggagatccacatatccatgtgcgtcacacggtcggagtttttgatgggacagcggtttaagaaggacgtgaggatatggtcggagatggcctccgcgcccagctcttcggcttcgacatccagcatcgcgtggatggagtcctgctcctttacccggaaattatcgagtttatcggcatcccggatgagcatggaatggaggcgttcctttccggtgagggagtcgtccatctggtagagcccatgattctttatggccgtatagatgatggaatcgtagccgcgttccggaatgaagctgcggatcagatggtcctcgaacagaatcgagaggcttaactccgcgtgaggtacgatggaatcgtcgaagctgtcgtatcttttcagctgttcgaagcggccgatgtcgtggagaagcgcaatgtgcagggccaggtcggtgtcctcatcggagaggccaaggcctttggagatcagccgggcggcgtctgttacgccgtaggtgtgtacgattttcagccggattttctcgtttttcgtgtcatactgctttaaatatccagcaaatattttttttgcctgtgtaaaatccatagacagaacccttctttcatactataatcttaagtgtctgcattatactacgaatcgcagacgatggcaacttgtaaaggaagagatgagaatgagcaaaaggcagatcagagccatattttttgatatagacgggacgctgcgtgatttcgagacgaagagggttccagaaagcacaaaagaggcgctgcggaaggcgaaggaggcaggaatcctgctgttcatcgctaccgggcgccataagcttgagatcgaggaggagaatctcctggaggacatggaatttgacggattcgtcacgttaaacgggcagtactgttactgcggcgaccacgttgtatacgacgatcccattgacggcgcggaagtcgatgccatgttgacgcttatcgggaaagatccctttccctgccttttcatggaggatgaccgcatgtatatcaacatggtggacgacgtcgtggagaaggcccaggctggaatcgggacaagaattccgcccgttatggatgtgaggcgtgcgtcagagcatccgatctaccagatcgtgccctatatcggcaggacgcgggaggaggagatccggcgcgcggttcccggatgtgagatcatccggtggcatgatgaatacgccgtggatgtgattccgcggggcggaagcaaatgcatcggaatcgagaagatggcagcccatttcggcctttcgctggaggagacagcggcggtcggcgacggagcaaacgacgtttccatggtggagatggccggtctcggcatcgccatgggcaatggaaaggctgtggtgaaagccgtggcggattatattacggattcgatagaaacggatggccttctaaaggctgtcttctatatattagagaataatcatcaggaggaatgaaacatgagtgaaacaaactgtactcataattgtaatacctgtggggagagctgcagcagcagacagacggagcagaccagctttctggagccgttaaaccctgcaagtacggttaagaaggtaatcggtgtggtaagcggaaagggcggcgttggtaaatcgctggtcaccaccatgatggcggtccgcatgaacgcaaaaaattataagacggcaattcttgatgcggatattaccggaccttcgattccgaaggcatttggcctgggagacgacggcgtcggcatgacaccgacgggactcatgatcccggcgaccacttccatgggcatcgaagtaatgtcggccaacttaattctcgatcatgagaccgatcccgtgatctggagaggaccagtgatcgccggagcggttaagcagttctggcaggaggccctgtgggaagatatcgactatatgttcgtggatatgcctccgggaaccggcgatgttccgctgacggtattccagtctctgccggtagacggcatcattattgtcacatctcctcaggagcttgtatccatgatcgtgacaaaggctgtaaacatggcgaaaaagatgaacattccgattcttggactggttgagaatatgagctacttatcatgtccagactgcggaaagaagattttcgtatttggagagagccggatcgatgaagtggcgaaggagaatgaaatccctgttctcgccaagatcccgattgaacccaagattgccaaagctgttgatgaaggcgccgtggagtatttggaagcaccgtggctggacgaggcggttaaagccgtggagtccatataatatgcgtttcgtgacagcttaaggataggacagcgaggtagaaatatgaatataaatatgaaccccaacagcgaactgcaccagtccatcgttaatgtgccgaatctggtacaggtcccggacccgctcatgaagcaggcgtaccagttccaggaagcgatgatgatgtacacctgtgcgatcagggagattaagacgaagctggaggtcttaaacgacgaactgtccgtacgcaattccaggaatcccattgagatggtgaaatccagagtgaagaagcccctgagcattgtggagaaactgcagcggagaggtcttcccgtaacgatggaatccatgatggataatctcgacgatgtggcgggaatccgtgtcatctgttcttttttagatgacatctatgccgtagccgatatgctgacccgtcaggacgacgtgcatatcatcgccatcaaggactatatccgccatccgaaggagaatggataccggagctaccacatgatcgtggagattcccgtcttcttttccgaccggaagaagtggatgcgggtggaggttcagatcagaaccattgccatggatttctgggccagcctggatcatcaactgaaatataagaaagaggtcggtgacagctcggaggaaatcagcgcagaactgcgggagtgtgcggaggtcatcgcacagacggatgaacggatgctgaagatccggctgaagattgaatcagagggaattactgtcagtaaatagtaaagcgaataagaggaagttcattctataaaataagaagctgatgccttaaatccggggataccggagggcgtcagcttcttatttttataggatatgagcggttattgaccgtctgaatgatcgtgaagcttcagcggcatggtcagatggcggatcatgatctgataggcatcgttgccattaccttctctgagggcgcggtagtagagctcgtgttcctccagcgttccatcgacacggccagtgaccgagagcgcggtggccgatgttaaatggatcaaatacagcaggcgctggaacagctgattgaactcatcattctccgcataaccgacaatggccagatgaaaggcgtggtcgctgtcaataaaggtctgaaggttatcatcgagatcttttgccttctgcatctgctcaagtatccgtccgagctcatccagcagccgtttccccttttcagtggagagctgtccggctatgatatgggtgcagaagccttcaatggcacagcggacctcgatggtttcctgcatgtccttatcggtcaggtggcggagcataaatcccttgctggggacgatagaaatatatccatcctggcttaaacactgtaacgcttccctgatgggggttctggatatgcccagctctttggacaggcgcgcctcagagtagagggtgtccggcaccagctttccttccagaatctgttcttttatgtaatcgtatgccttggattgtaaaaagcttttttctttcaatgtgatgcatctcctgtttgtttgacataccattattctaatatagaagttgtttttggtcaatcactcttttaaaggacattttgcggataagaataactgtgaactgtaacaaataaccgatgaaatcggaaatttttgttttgttggtgttgacagtataccggtatagcggtatactggttataaagagcaacggtagttatttattatattaaaatagaggaggaagacaggatgtgcgtttataagatggggaatttgagagtggtggatttgacgaaggagctggatccgaagacggagagccggagatgccacatgtatcggttcaataccggggggccgattccggattaccatacgattatggatcttaccagccatctggggacacactgtgaatgcccttaccatcatgatgacaactggccgagcgtggcggagctgccgctgaccacatttatgggcagggcattgtatgtggatttcaaggaggacgctgcaccgggaacccacattacggctgcggatcttgacaaggctacggcaggaaagcttaaggaaggggatattgtgatcattgattcctcctataagattcctccgtttaccccggcgaccaatacggaggcggacaagcggcttctggtaggaaaagaaagcgcggagtggttccgggatcataaggtgaagtgtgtaggctttggagacggcgtttcgatcgaaaactgcaatgaggatgtcaagccatttcatgatatactaatggcagagaatattgtattccttgaggtcctgaaaaatctcgagaagctggagcaggatgtattcttcatgagctacgccccccttccgatcctcggcctggactcctgtccgatccgtgcatatgcaatcgaggggctggcagacttttcaaactaaaaagtcagaaaggcaggatacccaaatgaaaataacagtcattggcgccggagccatgggctccgtctacggcggccatttatcaaggaagcatcaggtatatctggtagacacgaatccggatattgtaacgcagatcaaccgggaaggactgaagatcgatgaggatggcgtgatgaatacgtaccatccgacggcggtaaccggcacggaagggctgggggagatggacctggtcattctgttcgtgaagtctatttattccagggccgcgctggcggggaatcagggcgtgattggggagaaaacacgccttctgacgctgcagaacggcgcaggccacgaggatattttaaaggaatttgtccccgaagaccgtgtgatcatcggcacgacggaggacaatggcgcggtactggcgccagggcatgtaagaagaggcggagttggtaatacgaatgtagggatgctgacggaggaccgcgaagaattcctgccgcagctgaaagaggcgtttgacagctgcggatttcaggtgaaaatccatgagaacattcagtatctcatctgggacaagctgtttaccaacgtttctttgagcgcagtaaccggcatcctgcaggtcgatatgggatttatcgcggagaatgaatacgcatggaagttgacgaagacgctgattcacgaggcgattgcggtcgccggtgcgctgggcctttccttcgacgaggaagctgttacggagcgggttcgtcagaccgccatcgggaatccggcgggatgcacttcgatccgtgcagacctgcgcgatggcagaaggaccgaggtgaataccatcagcggctccgtagtgactgcggcagggcggtgcggcgtttcggtgccgagccatgaatttgtcgtgaatatggtacacgcgatggagatgaaaaaataagctgcaacaacagacagcccgggacaactcttgataacaagagccgtcccgggctgtttcgtccctctactaaggaaccggaaacattaccgtaaatgtcgtcccttcctccaggctgctggatacggtgattttccccttatgctgttctacgatcgtcctggctatggaaagccccaggccatatccgccttcttttctcacccgcgatttgtctgtgcggtaaaaccgttcgaagatatgcttctgatcggacggagggataggctctcccgtattattgacggtcagcaccgcgtgatggggggaggacttcagggagacggagaccgttccgcggatgccggcgtatttgcaggcattgtccagaaggattgtaaccacctgtttgatctggggctcgctgccgcagatgtggatgccgggaacgatgtcgttgtttaaggtgaccttgttctcaaatgccaccgattcaaagagcagaacacagttcagcacgctgtcgctgtaatcaaactcggtatttgccgtgtgggtgacttccaccgtgcccgcatcggagcgcgcaagaaagaggagctcctccaccagctgtttcatgcgggatgcctcctccttcgtgttgtcaacccatttgatctggctcttaatggatgagtcctgatgggagagcagaatctgtaaattagccaggatgaccgtgagcggcgttttcagttcgtgggacgcatcggcgataaactggttctgctgtttccatgcctgctccaccggctttaaggcccagcgggacaggaaaatgctgagcagaagaaacaggatagcggcgatgaaaaacagcaggaggcagttaagacgcagtgcccggatgttgttcagctcaaagctctgatcggcgaacgcaatggtgatgctgtccggcgtctcggagcggttatagcgaagggagtagtcttttaagacgcctcgcggatcgccgttttccatgacaaggtctgccagagtggccgccatgtcatcggatacggagagattgtttgtggttacgtccgtcaccgtctgcccatcctttgaaagggtgatgaccgcggtggggacgaagggcggcggcgtatcgtcggtccggcgtcccggttccactttgttcggttttccattgaagcgggccgaatcctgggcctgcatcagggccatctcggtctggcgttccagccgccagagattggcatgataaaaattccccagcacgatgatgagaatcgtgatgaccagggacatgttgatgataataaattttccgcgaagctttttcagcatgacggttcctccagacggtaccccactttccggacggttacgatttccaccttggagcttaagaaggaaagctttttccggagaaaggaaatgtaggcttccacgttgttgtcctccgcgtcggaatcatttccccataccctggaaatcagcatatccttggaaatgattttgcccgcattgttcatgagcagtttcagtacctcaaattccttatatcccagatggatggactttctgccgcgcaccaggtcgttagttgaaagattcagggtcagatctccaaaatgaagctcttccacgaccacctcgccctgtctgcgggagagggcgcgtatccgtgccagcagctcttccgggataaacggcttcgtcatatagtcgtcggcgccgcggtccaaaccggtcaccttgtcgcttatgtcgtctctggcggtcagcatcagcaccggcgtctggacatgggcctttcgaagcttcttcaccacatcgaatccattttccccgggaagcatcacatccaggacgatgacatcgtattcgcccgacaggccgcagtagaggccgtcggtaccggtatacacgatgtccgtgtgatagtgctgttcctccataatctgtcccagcgcgtcggccagtctcacttcatcttctacgatcagtatattcatgaatcatttccttccttttccggtatggccgaagcggccggtccatatccttatcaatattataaaaggggtttcctcgtttggcaatcccattccttttccagtatccgcattttatagatattattatagaaggagaagctgaaaatagcctgaaaccggctttcaggttaatttcaggtacccgtgatagaatgggacgaatgaaaaaaggctgaaaaggagtttcaggttaatttcaggttgctgacacaaaatgaacataggcacctgataaactgaagcagaacaacagacagagtgcagagaggagcaaatcggatgaatggaagaagaatagccgcttccatggcggtggttgtagcggccacggctgtgatgcccataacggcggaggcttcgacaaatatcgacttgagaaaaaaggtgatcggaatatcggggatcatgagtgtgaccaacatggattctgccattacgagaggggagtttgccagcatgctggtgaacgcgtcttcctacaggagtacggtcagcagtgtgagcaatacttctgtgtttgccgatgtaccgcgtgaccatacgtatgcggcgtctatcaggattgcggcggaacagggctggatgacgggatacttgggcgggaattttaagccggatgagtatgtgacgcttcaggaggccatcaagggaacgctggcgctgctgggatatgaaaatacggattttaccggagaccagaccggggccaggcagtccaaataccatttcctggagctcgatgaaaatatgaataagagcccggaggaggtcctcataaaggaggactgcatcaatttattctacaatcttttaaagaccgatacgaaggcgggcaccatgttcggaaagagcctgggatgcgagctgacctccgacggggagatcaatccgcttaccatggtggacaacagcctgaagggaccgaagatcgtaaggagcaagagccgcctttccgattatctgccgtttaagctgagcgctgccagcgtatacctcgatgggtcgccgatctccaacagcagtgaagccatctctgcggcgctggagaatgataacggcgtgctggtttactaccatcccgtatccaaaacagtatggttgtatacagttggaagcgaaaatgagaacgggcgttccgcggtattcggtgagatcacaaatgtcatatataattcggccgatttgatgacgccggacgccatcatactggatgacggcaatacgtatgaactggacagcaccgagatgaagtttgcattttccacatacggcgatatgcgggtgggagatacggtcactctggtctattccgtgacaacggacagcaacggcgacgagacgcgtaccgtgcttgattatattgaagactgacaggagagcctgagatgaagaaaataagttttggaaataaggcaaagaatggaaaaaagggcggcaggaaggggaaaaagcttcttctgattctgattctcctgctcgtcgtcatcttgggagtttatgcagcggttcggatgaaggcggagaaagcggccagcgcgaacgcgaaagaggtcaggaccgcgacggtggagacgcgcgatatcacctcggagctgtcgtcatcgggtacgatctctccgaagaatacatacgatattacctctctcgtggagggcgaggtgatcgccgccgattttgaagagggagatcaggtggaggcggggcagatcctgtatcagatcgatacctcatccatggaatccgagctgaccagcgtcaacaattctctgacgagggcgcaggaaaattacgaggtcgccctggatgactataacacggcgctcagcgattacagcggcaatacctacaaatcaacagaggcgggctacatcaagactctgtacatcaaagaaggcgataaagtgagctccaatacgaaaatcgccgacatttacgacgacaaggtcatgaagatcaaactgccatttttgtccggggaagcggcttccatcggagcgggcagcggtgcaacgcttacgctgacggatacgggagagcagctggcgggaacggttaccgcggtgagcaacatggatgtgacgctgacaggcggccggattgtccggtatgtcaccatcgaggcggcgaatccaggcggcttaaccaccgacatggctgcgacggcgacggtgggagactttatctgcagcgcggagagctcctttgagccgacgctggagactgtgatgaacgctgacatttcctccagcgtggaggtgggaaagctgctgatcagcgagggcgattacgtgggcaagggaacccctgttttcaccatggaagcgaaatcggcggagaagcttctccgaacatacaaggactccgtggaaaaagcggaggaaacgctggaatccgccaaaaacaaggtggacagtacacaggataattacgataattacacgatcacagcgccgatctccggtcaggtgatcacgaaaaatgtaaaggcaggcgacaaggtggcgaagagcaccagcggaagcacgacacttgccgtgatatacgatatgtccggctatacctttgagatgtcggttgatgaactggatgtaaaggaagtggccgtggggcagagtgtagtgattaccgcagacgcggtgagcggaaagacgttctccggtacggtgaccaatgtgagcctgcaaagctcctactccaacggcgtgaccaactatcctgtcactgtaaccctaaacgacggcatggatgagctgcttccgggcatgaatgtggatggcgtcattatcctcgaccaggcgtcggatgtgcttgccgtaccggccgatgcactgatgcgcggcaacaaggtctatgtaaaggacgatacggtaacggaggcgcagggaacggttccggcgggcttccgggcggtcgatgtaaagacagggctgatcagcgacgattacgtggaaatcacggaaggcctgtccgagggtgatgtggtctatgtggccgagtccacggtgagctcgtcatttaatatgatgggcggcatgcagggaggtcccggagacatgggcggcggaggcgcgcctggaggcggtaatggcggcggaaacggcggcggaagaagcggcggaaataacggcggcggtcccaggtaatggctggaggtagagacttggaagaaacattaattgaactgaaggatatctataagatctatgagatgggcgacgaagaggtgagggccaacgacggcatttccctgacgatcaaccgcggtgaatttgtggcgatcgtagggaaatcgggaagcgggaaatcgacgctgatgaatatcatcggggctctggatgtacccagctccggcgaatacttgctgggcggaaaagacgtggggagtatgacggacaatcagctggcggacatcagaaaccggatgatcggcttcatattccagcagtacaatctgcttcccaagctgaatctcctggaaaatgtggagctgccgcttctctacgcaggggccagcaatacggcccgccgcatgcgggccatggcttcgctggagcgtgtgggcctggcggaaaaatggaggaaccttccgaaccagctttccggcgggcagcagcagagagtgtccatcgccagggctctggcgggagacccgtccctgattctggccgatgagccgacaggcgcccttgattcgaagacgagccgcagcgttctggattttttaaaacagttaaacgatgaaggcaacaccatcgtcatgattacccatgacagctccatcgctatggaggcgcggcgtgtggtgagagtgcatgacggaaagatcaactttgatggagacgtaaatgaatattctgcaatcctttaaaatggcaatgaaaagtatcatgggcaataagatgcggtcctttttaaccatgctgggcatcatcatcggcgtggcctccgttatcatcctggtaagccttgtcaacggccagatgtcttacatgacagagagcttcgcaagcatggggacgaaccagatttcagtcaatgtgacgaatctttccacccgatcggtctctgtggatgagatgtatgaattctacgaggacaacagagacttatttgcccagatgacaccgaatgtgaccgtatccacgactgtaaaaaacgggacggagtcatcgacctcgacaacggtgtccggagtcagcgaggaatacctggagatgaaggatatggagctggaggccggccggtttatccagtattccgatattgtatcgcgccagaaggtgtgtgtggtgggatattatgtggcgtgggatctgtatggaggcgtggataaagccctcgatcagaccattaagatcggaggaaatgcgttccggattatcggcgtggtgtcgagacaggatgacgatgagctggaatcgggcggaagcgatgatttcgtctggatgccgtacagctgcgctgcgaagatgacgagaaacgccaatatcagcagctacacgtttgccacggccgatatgaatcatacggatgaggcaaagacggcgatcgatgatttcctcatggaaatctttaaggatgaggatttataccggatcacggcgatgagcgagcttctggattccctgaattccatgattgccatgatgtccatgcttctcggcggcatcgccggaatttccctgctggtggcgggcgtgggagtaatgaatatcatgctggtgtccgtaaccgagcggaccagggagatcggtatccgcaaggcgctgggggcgaagaaacggacgatcatgcagcagttcgtcatcgaggcggccgtgaccagctccatcggcggcgtgatcggaattgtgatcggatccgtggcgactacggtcatcggaacagccatgggaatgaacgcgacgccgacgccaagcgccgtggcagtgtccttcagcgtctccgtggggatcgggctgctgttcggatatatgccggcaaaccgggcggcgaatttgaatccgattgatgcgcttcgaagtgagtaggaagggttgcaaaattggaataatagtgatactatttgcatagttacagaaggagtagctcgttgggagttgctcctttttgagaatgaagacatagaggagtttaaacaatatgaaggttgtggatatgcactgtgatacgatttcggagctattttaccgcatggaggaagggaaggagcattcggtttggaagaatgactgccatgtggatctggagaggatggagaagggggactactgtctccagaattttgcgatgtttacgtcgctggacaggtatgagaagccgtttgaacactgcatgaagctggtggacctattttatcaggagctggaagagcatggtgaccggattgggattgtgaaaacgtatgaagatattgaggagaaccggagactggggaaaatgtctgcgctgctgacgatcgaggaaggcggcgtctgccagggagaaatcgcttttttgagggacttttaccggttgggagttcggatgatgacgcttacctggaattttcggaatgagctgggctggccgaatataatccggattgaaggggacgaggcgtattttgaaccggatacggagcacggactgacggagacggggatcgaatttgtcagagagatggaacggctggggatgattatggatgtgtcccacctgtctgacgcggggattatggatgtattccggtatacgaagaaaccattcgtggcgagccactccaacgcgagaacggttgcctccaatccaagaaacttaaccgatgagatgcttaagatgctttcggagcgcggcggagtggccggcatcaattactgcgcggactttctgcatgactggcagagagatgaacacgcagtgagccgcgtcgatgacatgattttacatatgaagcatatgaagaagatcggcggaattcagtgtatcgggctgggatcggatttcgacggaatcggaggggaactggagataaaatccccggaagacttgccggtactggagcaggccatgagaagggccggctttacggaggaggagatcgagggcgtgttctataagaatgttcttcgtgtatacaaggaaattttaaaataagacaaaattttacatagattttacattcccgtgcatcatactttacatagatttgatatagtgcttacataatcaatcaatttatttcatgaaaaccgggaggggactatgtcaatcactgatttacagatgctgtttaaatttatcgggggtctgggaatgtttctctatggcatgaatgccatggcggatggactgcagaaatctgcgggacaccggatgcagcagctgttgggagcattaacgaagaaccgtctgatgggcgtgattcttggagcgggtattaccgccattatccagagcagttccgccaccacggtcatggtcgtcggcttcgtaaatgccgggattatgaacctgggtcaggcggtcggcatcattatgggcgccaatatcggaaccacggtgaccagctggatcgtatccatgagcgaatggggcgagatgctgaaaccggagttttttgcaccggccctggtgggcgtgggtgcggtcatgacgctgttttgcaagaacagcaagaagaaacaggtgggagaaatcctggtgggcttcggcgtgctgtttatcggcctgacctttatgtcggcctccatcactccgtaccgcgacgctccgatatttgcacaggcatttacggttctgggacgaaatccgtttctcggtatccttgccggtgcggcggtgaccggaattatccagagctcttccgcgtcggtgggtattctgcagacgctggcgttaaacggaatcgtgaactggcagtccgccatcttcatcacgctgggccagaatatcggcacgtgcgtgacggcgctgatctccagtgtcggagccaataagacggcgaagcaggcggccggaatccaccttctgtttaatacggtgggagccgtgctcttcggaatcgtgatgtatctcatctttaaactgaatccggtgtttgcgtcatcgacgatcagcagtgtggaaatctcgatcttccataccgtattcaatgtgagcaatacgatactcttattcccctttgcgggacttctggtaaaggcgtcaagcttcatgatcagagacagcaaaaagggaaaggaagagaagaaaggctcccagatggagcgccacctggacgagagaattttagagacgccgtccttcgccattgagaatgcgacacaggaagtaatcaatatgggaaaagcggcgctggagaattttgatattgcaaccgcggccttactggagggcagcagggcagaagcggagcaggtggagaagctggaggcaaagatcaaccagtacgaaaagattctgacctcctatctggtcaagattaacaatcagtccctgaatgaggaacagcatctgctggtgaagaatttattctatacggtcagcaactttgaacgcgtcagcgaccactgtgagaacctgtcggagctggcggtggagaaggcggacaagaatatcgtattttccgtggaggcggccggcgagatgaaggaaatgataaagacggtgcgttctgcactggagcacgccatcaacgccaggggcggcgccggaatgtctgaggtacgggccgtggtgcagagcgaggagagcgtggacatgctggaggaagaactgagggaacgccatattgagcgtctgtccagccataagtgtactccggaaaacggcatcgtatttttggaggccttgagcaacctggaacgtatttcagatcacgcccataacatagcgggatttgtgagagatgagatgtaggaggcgcgtatggaaagaatctatgtggtagaagacgacgacaatatcagggatttaatcagaatcgccctggagggctttgggtatagtgtctccgcctttgagatggcggaggacgccctcaaaagcatcgagacagacatgccggatctggcggtgttcgacctgatgcttccggggatggacggcctgagtgcgattaagagaatccggaaaaatgatgccatggcagacatgcctattatcattctgactgccaaggacagggagtttgacaaggtggcgggactggacggcggcgccgatgactatatgacgaagcccttcggcgtcatggagctggcggccagaatccggagtctgctccgccgcagggcgagaaaccagaacgaggaagagattttagagaaatactgcatcagtctgaataaaaagaccagagaggttttaagcagcggaaaaaaggtggagctgactttaaaagaattcgaactgcttttgtaccttatggagaatcaaagcaaggtggtcacccgggatgaactcctaaatcacatctggggctacgattacgacggagagacgaggacactggatatgcatatccgaacgctccgccagaagctgggcgaggaaggcggcttctgcatccgcacggtgcgcggcgtgggctaccgctttgtgaagacggaggaaggctgatatgcggaaggccatatttgtaaaatttattcaggtaatcctggcggcgctgatcttaagcagcgccatcttttatatagcagccagcagcgcgctcttaaagagctccagaaaggacatgacctacactctgcgggccatcgacagcgttctcgactatagcggggatttacagggcgaggtgatgatgctggaggagacggtgaatgacaacagcagccgttttacggtcatcagaaaggacggaagcgtcgcggccgatacgggcgtggtggatacttcttccatggacaaccacctggaccgggaggagattaaggaagcactggaatcggggagcggctcctccaggagatattccgatacgctgaagaaaaatatgctgtacgtggcttatgattcggatcattctgactatatactgcggatggctgtaccgtttaccggatttaaggagtatttgatcctccttcttccggccgtctggctcagctttctggtggcgctcatctattccgcctgctcggccgacagctttgcggcctccatcacgaagccgctgaaggagatatcgcaggagatgctgaaggtcaacggagactatacggagctgacctttgagacgtaccagtatccggaaatcaacattatcgcggagacgacgacggaaatgtcaaagaatgtcaaggagtatttaaaccagatcgaactggaacggcagatccggcaggaattcttcagcaacgcctcccacgagttaaagacgccgatcacgtcggtacagggctacgcagagcttctggagagcggaattattcaggatgaggaacagaaaaaggacttcatccggcggatcaagaaagaagcggtccacatgaccagcttgatcaacgatatcctgatgatctccaggctggagacgaaggaggccgagatggtgtgccaggacgtccggatgtccatcgtcctggatgatgtgctggaatcgctgaagccgctggcggcctttcacgaagttctggtccacgcggactgcaagccgctgtgcatctacgccaacgcccgccagatgacggagcttttaagcaatctgctcagcaacgccataaaatacaacaaaccgggcggagaggtctgggtgaccatcacagaagaagacaaggaaatgatcatacgggtaaaggacaatggcatgggaattccaaaggaatccctgggtcgtatcttcgagcggttctaccgggtagacaagggacgaagccgcaaacagggcggaacgggcctgggattatccattgtaaagcacattgcaggttattatcacggaacgattacggtacagtctgaactggaggcagggacagaatttacggtaaagattccaatttgacgaattttgtgatagaatgtaaaaggctaatcacaaaaggaggtgtgcggagtatgaatcaatttgtattaacatgctgttccacggcagatatgaagaaaacgtattttgacgaacgtcagattccctatgtctgcttccactacttaatggacggggtgtcctacccggatgatttgggacagagcatgccgtttgatgagttttacaacaggatttcaaaaggcgccatgccgactacatcacaggtcaacgtggctgagttccatgatttttttggagctatattagaggagggaaaggatattctccatatcagcctttcctccggcatttcaggaacctataattccgcctgcagcgcggtggaagagctgaaggaggagtatccggaccggaagattctggtggtggactccctgggggcttcttccggctacggactgctggtggacgcggccgcggatttacgcgaccagggcctttctctggacgaggcgtaccggatcacgatggagcggagacttcacgtgcatcactggttcttttccacggatttaaccagcttcaagcggggcggccgtatttcggcgacctcggccatgctggggaccgtattaaacatatgcccgctgatgaacatggatcatgagggacatttgattccccgccataagatcaggacaaagaaaaaggcgatgcaggaagcggtccggatgatggaagagcacgccgatggaaagaacgggtacaaagggaaatgcttcatttcctgttcagcctgcgaagatgacgcgagggccgtggccgatctggtggaggcgcgttttccggagctggacggcagagtgctgatcaacagcatcggaaccgtcatcggagcccatacggggccgggaaccgtggctctgtttttcttcggtgacgaaagaaaggattgacaaaaaaagcaggcagtgatagactgacatacaacagggagctcgtgcggcgggctgagaggaagtgctcaaacttcgacctattacctgatttggataatgccaacgtagggaaatatgagatgacagggatatttgccgcccataccagacgtttggtatgggcgctttttttgtttcatgggaaagtttgtcctatgaaaaaaaaaatccgggggccgctgaagcggccgcgctccggcgcacgagtccggcttgccggactctttgtatgtgacaaaaaaacacaggaggaactgaagatgaaattcaatgttaagaaactggtagtgagcggcatgctgaccgctctggcggtggcgctgtccaccttttccgtgccgatcggggcgtcgaaatgtttcccgattcagcacatggtaaacgtcatggcaggcgtatttctggggccggtctacggtgtggcaatcgctttctgcacatcgctcatcagaaacctgatgggtacgggaagccttcttgcatttccgggaagcatggtgggggcgctgctctgcggactggcctaccgctggaccggaaaactgaccgccgcctatgcggccgagatcatcggcaccggtataatcggagcgacgctctgttatccggttgcggcgattcttatgggaaaagaggtcgccctgtttttctatgtagcgccgtttttgatgagcacgctgtgcggaacggccatcgcggcgattctgatcggcgttctctgccgttccggcgcgtttggatacttaaaacgccaggttgcggcaaaagaataggcggagaaattattctccgccggtaatacgggcgatcatgcggttgggaaggcagatgatggcttccccggtccgccggatcgtcccctggttgacacagaccttatccggacagctggcctcggtgacgtgaaccgttccgtctttgatgacgacgtggttcgtcccgccgttccagccttcgacggtgagctctgtgtctttatttaaatcaagggtttcaatcacagttccatccaccgatatttcgactctcataggtggttttgaaaaaataatccgcgtgcccgcataaagaagcgcggaaactgctaaaataacaaggatcagaacgagttccttcttcttttttccgatatgtttattctctgcactcatcattttctttcctgttcttcgtactttcgagcaatactgtgttgaattagcataataaagtaccaaattcctacatatttttccaattctccagcaattgcccttcatagtataacacaatttccagaattatacatgaagttataaaaattttataaaataatcaaaatcattaaaaaaagcattgcttgaatcgttaagaatatgttaaaataaaaacaaagtagtaaattgtacatttcaggaggaaatcatgaataaaggcagtatggatacgaagaaaaagggactgatcgggctgggtgcgctggtggttctggcgggagcaacaatactcggatccgatccgctttacaaagcaattgacgatatggcacgtccggcgatctacacggcgggaacgtacacggcgtctgcccgcggatacggcggacccgttaccgtaacggttaaggtttccacaaaggcgatcgaatcgatcgatgtagtgggagagaaagagacacttctggatcaggtagtaccatcccttccggatgcaattattggaaaacagacgctggatatggatgcggtttcaggcgccacactcagcagcaacgcgatcattaaagcggtggaaaaggcacttgccgaagccagaggcgaagccgtggaagaagagacaacaaaggcagaggaaacagcgactggctggaatgacggtacatattcctatgaatcccctgaattcgatgacaacggatacaaggatcaggtgaatatgaccatcaaggacggcaagatcacggcgctttcctgggactgtgttgataaagacggaaaactgaagagcaatctctccatggatggccagtacgtgatgacggaagacggcccgaagtggtatgagcaggcggatgcagtcgtgcaatacgtgctggatcatcagtctctggacggcctgatcaatgaagaaggctataccgacacggtagcttccgtgagcattaacttatatggatttgttaatggtgtgaaggactgcctgaagcaggcggccggagaagccggaacaaaggccggttggaacgacggatcttactcttatgaggcgccggagttcgacagcaacggatacaaggatcaggtagccatgactatcaagggcggcaagatcacctctcttacgtgggactgtgtggataaggacggaaagaaaaagagcaacttatccatgaacggcgagtatgtgatgacggaggatggcccgaagtggcacgagcaggcggacgcggtcgtgaaatacgtgctggataaccagtctctggacggtctgatcaatgcagatggctacaccgatacggtagcttccgtaagcattaatttatacggatttgtaaacggtgtgaaggactgtctgaagcaggcagccggagaagccggaacgaaggctggatggaacgacgggtcttatacgtatgaggcgccggaatttgacagcaacggatataaagaccaggtagccatgaccatcaagggcggcaagatcacagctcttacctgggactgcgtggataaggacggaaagctgaagagcaacttatccatgaacggcgagtatatgatgacggaggacggcccgaagtggcatgagcaggcggatgcggtcgtgaaatacgtgctggataaccagtctctcgataacttaatcgacgcggatggctataccgatacggtggcgtctgtaagcatcaacctgtacggatttgtaaacggagtgaaggactgcctgcgtcaggcatcttcggaaaacgcggcaaagagcagctggaacgacggatccttctcctatgaggcgccggagttcgacagcaacggatacaaggatcaggtttccatgaccgtgaaggatggaaagatcacggctctcacctgggactgcgtggataaagacggaaagaaaaagagcaatctctccatggacggcgagtacgtcatgacggaggacggcccgaagtggcatgagcaggcggatgcagtcgtaaaatacgtgctggagaaccagtcgctcgacggcctgatcaatgaggacggctataccgatacggttgcttccgtgagcatcaacttatacggctttgccggcggcgtggaggactgtctgcgccagtcctcggaaggtggtacagcggcggcttccgtgaacgctgtaaaggatggaagctactcctacgaatctccggaatttgacggcaacggctataaggatcaggttgccatgacgatacagagcggaaagatcacggccctcacctgggactgtgtggataaggacggaaagaaaaagagcagcttatccatgaacggcgagtacgtgatgacagaagacggcccgaagtggcatgaacaggcggaatcggttgtggcctacgtgctggagaaccagtctctggacggtctgatcaatgaagatggctataccgataccatcgcctccgtaagcattaacttatacggatttacaggcggtgtggaagactgtttgaagcaagcttccaagtaagcagtgatgtgtgattagtattttagttactgctcactccgtgaccagcaacacgctgcgcgatgcacacaaactgcaaaaacgcagtttggcgctggccccctcgggttttctgtgacttccgctacgctgcactcacaaaaaacacctcgcactggttggccagtgaacagtaatgaattttaacaattgccggacttttcgaagtctggcaattgtattttataccggaaatatggtaagatggtaggcggaacaaaaaaggaggtaagactatgacaggaaagacggaacaaagccccgcccataagacggcgctctacggcatgctgattgcgcttgccttcgtgttaagcttcgtagagacgctgatccccatttcccttggggttccgggtgtgaagctggggctggccaatctggtgacggtcgtgggcctctatacggtcgggatcggcggaaccgtggccgtctccatgattcgtatcgtgctggtggcgtttacctttggtaatgtcttcagcatgatgtacagcctcggcggctgggccttaagcattctgctgatgatcctgtgcaaaaagcgggaatggttcagctctgtgggaatcagcgtcatcggcggcgtgggccataacatcggccagctgtgtgtggcggcgctggtggtaaagcaggcgggagtcttcgtttatctgcccgtgcttctgattgcaggtacggccgccggcctcgtgatcggcctggtcggagggatgatcgtggaacggcttccccgttttataaaaaaattataggaaaaacaaaggatatcgtattgttttacgcgtcccctcaagttataatagagggaaaacagtcatgaagaaaacaggagggattgggatgatttatgaggcaataaagaaactggtgcagtacgggttggatacaggactgattacggaggttgataagatctatgccacgaaccagattcttgacgtgatgcggatggacgagtatgaagaaccggaaggtgagtcaggtgagaccgatttggaatccgttttaaaggaattgctggattatgcccatgagacgggagttatgccggaggacagcattacataccgggatttattcgatacaaaactgatgaactgcctgatgcccagaccgggtgagatcgagaagaaattctgggagatctatgatggggagtcaccggaggcagccacggattactattataaactgagccaggattcagattatatcagacggtaccgaatcaaaaaggatatgagatgggtgacgcccacgaagtacggcgatctagatattaccgtcaacttatccaagcctgagaaggacccgaaggccattgcggccgctaagctggcaaagcagagcggttatcccaaatgccagctctgtatggagaacgagggatacgcaggcagaacgaatcatcccgcccggaacaaccaccggatcattcgtttaaaaattaacgacagcaggtggggctttcagtattccccatacgtatattataacgagcactgtatcgtgtttaacggacagcacattcccatgaagatcgagaagaacacctttgtcaagctgttcgatttcgtcaggctgttcccccactacttcctgggctccaacgcggatctgccgattgtgggcggttctatcctgtctcatgaccatttccagggcggcaactataccttcgccatggcgaaggcgccgatcgagaagtattaccagatggaggagtttccgggtgtggaagccggcatcgtgaaatggccgatggctgttttgagaacccgcagcaagaatccggacgacttaatccggctgggagaccgggtattgcaggcgtggagaggctatacggacgaggaagcgtttattttcgcagagactgacggggaaccgcataatacaattactccaattgccaggaaaaagggagagatgtacgagctggacctggtgctccggaacaatattacgacggaggagtatcccttaggcgtataccatcctcatcaggagcttcatcacatcaagaaggagaacatcggcctgatcgaggtgatgggactggccgtccttccttccagactgaaggccgagctaagccttttggccgagtatattctggagaaaaaggatatccgcagcaacgagatgatcgagaagcacgcggactgggcagaagaattcctgccccagtatccggagatcacgaaggatacgattgacgggattttaaagaaggaagtaggccttgtattcgagcgcgtccttgaggatgcgggcgtctacaagtgcgacggagagggcagggaagcgttcggacgtttcctccacagcaccggctttctggaagcataaagtggtttttgcaggctggccctgccacagacatattgttgtggcagggtcagcctgtttggtgtttgtaattgtaatacgattgcgctatattctattgggaataagaggcgtgcctctcatttactagcagggagcgctctccgttttcgggagcactcgcgtgataaaagggggaccggctggaagaaaaggccggggctgacagacgaagtcatgaaacagattgaaaacaaaacactcagaacactggtggagtatgggatcataacaggcagtatctggattatggtcatcggaatttattttttcaaattcccgaataattttgctttcggaggtgtcacgggttttgccacggtagtgagcgcgatgacccactggtcggcaagtgaatttacgaccatcgtcaacatggcgcttttagtgacaggttttatttttttagggcgtggatttggcgtgaagacggtgtacgccagcatcctgatgtcatttaccctttcatttttagaacggacgtgtccgatggtccgtccgctgaccaatgagcctcttctggaattgatctttgcgatatttcttccgggagtcggttcggcgatcctgtttcatatcggcgcatccagcggcggaaccgatattctcgcgatgattttgaaaaagtatacgagctacaacatcggcacggtgctgcttgtcgtggacatggctgcggtgatcatggcgttctttgtgttcgggccggagacgggactgttctcttccctcggacttatggcgaaatcgctggtcatcgacgatgtgatcgagaatatcaacctatgcaagtgcttcagcatcatctgtgacgatccgggaccgatctgcgactatattatcaacggcctgaaccggagcgcgacggtgtacgaggcgcagggagcgtttacccatcaccggaagacggtggttctgaccaccatgaagcgttcccaggcgttaaaacttagaaattatatccggcgtgtggagccgagtgcatttatcctgatttccaattccagtgaaattattggaaatggatttttagcagggtaaaaagtgataaaaccatttctctgttttcggcatttttaacaaaaatccactttaatgctttaaacacacataattttaaagcaatgaaattgacggggtggattttttgtagtatgataccaattaagttcagatcgaacgagatttgtgaagaagaggagagattggttatgaaaaaaacagcaaaagtggcatcactcatcctggcaggcgctatgatgatgtctttaacggcatgtgggagcaagccggcggagacaaccgcggcaccagagacaacgacggcagaggcggcttcctccgcagctgacacgaaggcagaagagacgacagcagaagcggccgggacggacgacggcaagcagtttaagatcggtgttcttcagctggtacagcattccgcgctggacgcggcaaacaagggatttatccaggcgctcgatgacgccggacttaattatacggtagaccagcagaacgcctccggcgatcagccgacctgccagaccatcgccagcaagctggtgaatgacggcgacgacttaatccttgcgatcgcgactccggctgcacaggcagtggcaggtgcgacaacggatatcccgattctccttacggcggttactgacccggccgagtctgatttagtagagagcaacgatgttccgggcggtaatgtcagcggtacttccgatttgactcccgtaaaggagcaggtcgatttattaaagcagattcttccggatgcacagaccattggcgtactttactgctcagcagagtccaattctgagattcaggcgaagatggcgagagaagctattgaggcgaagggcatgaaggccgttgattatacggtatcgaactccaatgaacttcagactgtagttacctccatggtaggcaatgtggatgcgatctacgcgcctacagacaacaccatcgcagcagggatggcgacggttgctatggttgcgagcgacaacggaatcccggttatctgcggagaagagggcatggtgaacgcaggcggcctggctacatacggaatcgattacttccagcttggttacttaaccggccagcaggctgtcagaatcctgacagaaggcgctgatatctctcagatgcccatcgaatacctgccggcagacaagtgcaatctgactgtaaacgaagatacggcggcagcgcttgggatcgacgtttccgggctcaaataaaagaatatttatgaacaggcagatgccagcggcggcaggcatctgtctgtttctacataaatgctttacataaagaatgcggaagtgtattctttatgtaaggcatttatgagcgttatcacagacgcttaaggtaatgccagaaagataaagatgcggaggaatggttgaatgaacggtttactggtatcccttcaggatgcggtagtacagggagtcttatggggaattatggtactgggtgtctacatcacctacaagcttttggacattgccgatttgacggtggatggaagctttgctttgggcggctgtgtctgcgccgtcatggtattgaacagagggatggatccctgggccgcactgattgtggcggcagcagccggcatggtggcaggagcggtgacaggatttttacatacagtgtttgagataccggcgattctcgcgggaattttgacgcagatcggactgtggtccatcaatcttcggatcatgggcggcaagagcaatgtgcctctgttaaagaccgacacgattttctccaggatcatcggatggacagggatcaataaacaggtcgcttcccttctcctgggagtcggagttgcgatcgtgatgatcgcctttctgtactggtttttcggtacggagatcgggagcgccatgcgtgcgaccggcaacaacgaggccatgatccgggcgcagggcgtgaatacgaactggaccaagctgctggcgctgactatcagcaacgggcttgtaggcttatccggcggactcgtatgccagagccagaagtatgcggacatcggcatgggaaccggcgccatcgtcatcggtctggcggccatcgtcatcggcgatgtgctcatgggacgccttcgatccttcggcagcaagctgacctcggctgtggtaggctctgtcatttacttcgtcatccgcgcggtggtactgaggatgggtatgaatgccaacgatatgaagctgctttccgcggtgatcgtggcggttgccctctgtgtccctgtcgtggtgagaaaatggcggcttaagaaggcttacacggaagggggagaataattatgctggatattcagaatgtcagaaagacttttaataagaatacgatcaacgagaaaaaagcgttaaacggcattaaccttcatctggacgaaggtgattttgtgacggttatcggcggcaacggcgcggggaaatccacgatgctcaacatgatcgcgggggtataccctatcgactccggcaagatcgagatcgacggcgtcaatatttccagggaaccggagtataagcgcgcccgctacatcggcagagtcttccaggatcccatgatgggaacggcggcaggcatggagattcaggagaacatggctctcgcattccggcggggcaagacgcgcggcctgggctggggaatcaaggccaacgagaaggatttctaccacgatgccttattgaagctgggactgggactccagacccgcatgaccaacaaggtaggtctgttgtccggcggtcagagacaggcgctgacgcttctgatggcgacgcttcagaaaccgaagctgcttctgcttgacgagcacaccgcggccctggatccgaagacggcgaaaaaggtgctggagatcacgcaggagatcgtggaagagcagaatctgacgactctgatgatcacccataacatgaaggatgccatctctatcggcaaccgccttatcatgatgcatgaaggccgcattatctatgacatttccggggaagagaagaggaacctggaggtggaagacctcttaaagaaattcgaggaagcaagcggcgaagagtttgcaaatgaccgcatgatcctggcgaagtagcatcgtatacatatttgtgtcacagaatcgttacataatcttaataattatttattctttctatatcgcaattaccgacaaattatgctatactaaggcggataggctcgtagtctgacttgactgtttcaagccaaaaacgatgatggagtgaatattacacaatggaaaacaaaagcgataaaagtgacaaaaaagattacatcgttcatctgaacaaagccagaaagaagcgtaataagaatgattttgagagatacatcattctggcagtgatagcggttgtggtggttgtaatcctcctgtttgccgggaaggccatagcaaagcgtgtatcggcaggggcggaaaagacgaccgcagcgacagagacagagagccaggcggaagacccggggcagctgaagattgccgcgaaggaagctgaggagtctgaggcagaagcacaggcaaagaagacggaagaggaaaaaaaggcggttgtcgattcttatcagaatctcggaattgttttagtttccggatatttgaatgtgagaaaagaaccgaatacctcggcggatattgtcggaaagctgatgggagacagtgcctgtgagatattagacagtacacaggaaggctggtataagatttcttccggcggcatcgagggatatattgattcccagtacgtcctgacaggtgatgaggcgaagacgaaagcctatgagcttgtgacactgcgggcgatcgtgcaggttgacaacttaaatatcagaaaagaggccaataccacgtcggatgtcgtgggacagggccttataaacgagcggtacgaggtcatcggtcaggtcgatggctgggttcagattccgtccggttatatgtcggctgattacgtcaagctggagtatgcgttaaacgaggccaggaagctggatctgaaggccatgatcttcaatatgtacaagaacatcggtatctcggatgtggataactacttaaacgtcagggaagagcccagcgaggacggcaaggtaatcgccaagatgccgagcaaggcggcgggcaacattctcgagacgacggacaacggctggtacaagatccagtccggtaagatcaccggctacgtgaaatccgattatattctgaccggacaggcggccaaggatgaggcgcttaaggtggctgagctgatggccatcgtgaacacggacatgctgaacgcccggtccgaaccatccaccgattccaagatctggacccagatctcgaataacgagaagtatccggtattgaaacagattgacggctgggtagagatcgagctggaggaggacagcaacgcttatgtggcatcggattacgtcgatgtaagatacgcgctgcctgaggcgatcaagttctcaccgctggaggaaaaggccaacgcggcggcttctctcagaacgcagattgtaaactatgcactgcagttcctgggtaatccctacgtatggggcggcaccagcctgaccaagggtgcggactgttccggctttacactctccgtattcggtcattttggcatcagccttccgcactattccggtgcgcaggcgaatatgggaaaagcagtgaagtccagcgagatgcgtccgggagatctcgtattctatgcgaacagtaaaggaactatcaatcatgtgggaatctatatcggcaacggccagatcgtcaacgcggccagccggagaagcggtattaagatctcgacatggaactacagatcaccggtgagaatcaggaatatactgggagattaatccatataagagagcatgcgcagaaccatagacggttttctgcgcatgcttttttcgtatggaagattcgtattatgaaaaaaatcagaacgctcttttccatgataagccggagaaatgactcaggagagtctgcctccgtggaagagacacgtatagattctgacctcccggcagtagatggcctcttccccctgaaactggccgagggtaccctgtgtccggcagacataggtaaaatcctcgttccggaagtattccgggccgcggaggggaagttcggctggaacctgtgacagagcttcctttaagaaggcactgtaaaaggtctcgtccagcgatacgccatagtaattgagcgcccagacgggagtgtccctgatccacacggcttcctctcccgtaaaattccggcttcccagataggtgtcgatgtagagataatcctgttcggagtatcgaaaatcgtgagactgggggcgtgaaggaggcgcggtgttctggccggaggcgtaggtgcgctgtttagcccgcataagaaagcggcgaagcgccttttcagaagcagggtccgggtctaaaagggctggggcgcattcctcctcctgcctgacgaggcggtcgatggaaacgccgaagagttcactgagacggaccaggttgggaaaatcgggaaatgcctggccgttttcccatttggttacggcctgacgggagacgtccaggcggccggccagctcttcctgggaaagctttcggctggcgcgcaggtgctgtagtttttcgttgaaattcatgtggttcctcctttcgctgctatgtatgatcatacaggattatggggaagaatgcaaacaccctgtggtggcaggccctgcaactgtgggttgcggattattgagaaacagggataaaagaaaagcttttattaacaagttccagccggaagctgtgttaataaaagcttttttacaggtctgtttaaggaatctaattctcgctgtggcggttgcgattatagttaatcagacagccggcttttacgatctctttttcctcgctggtcatctccgcaatatggaggttgatctcgtgaatcggattgccctcttcattcttaatgacataggccggtatatgctgcatatcgccatctaaggcggcgcggacacccggaacgtagatgaaatcaccgatgtcgaaggacggctcctcatccagaaggaatggcagcatgccccagttaatcacgttggagcggtagcgcttggtagcgtattcgtttgcgatattggcgaggccgccgagaactctctggcagctggccgcctgctcacgtgcggagccgtcgccaggttttactgcatagatcatgcttccgatctcggtctctctggctcttaattccggctgatccaaataaatacgaagggcattgaacgctgcttccatctccggatccggttttaacggacaagcgccggtcttgcgaaccgcctccagttcattgaccttcttggaacggccgacatactccggatcgcgtctggaaagcgtgaactctgccagacccagcgggttagagcggtaggatgaggtctctccggaaggaatcagttcatccgtcgtggtgacagggtccatgatcttagagcagactctcaggataatattatcagtcagggcgctcatggctggccagtctttgatattcggtccgtagatcagttctgcctccggatctgcctttccataaccctgataaactcttctttcataggaggtgctgtcgaattcataagcaggtacttcataaccgtcagcaatggtttccgccgaggttaagtagcctccgtttgccgcggtggctgcgatcgagcgggcatccatcaaggcgacgcaggagatctggccgttacccggcttggaaccttcacggttcgggaagtttctcgtggtatggcggatgctcagtgtgttgttcgccggagtgtcgcctgcgccgaagcacggtccgcagaacgctgtacggatggtagcgccggcagccatcagctctgtaacggctcccttctttaccagatccatgtataccggctgtgaggacggataaacggacaggttgaagatatcgtttccgcagtccttgccggacaggatatgagcggccgtcatgacgttggaatagttgccgcctgcacagcctgcgatgacgccctgctgtaccaggagcttcccgtccacgatcttatcggtcagggataaatgaacattcggattgccgagaatatgatcggcttccttttccacggttcttaaaatatcgcccaggtttgcattcagttcgtcgatctcgtaggtgttactcggatggaatggaagagcgatcatcggcttaacggtgcttaaatcgatggatacgacaccgtcataataggcgacattcgccgggttcagctctttataagcctcctctctgccgtgcatctttaagtagtccctcgtgtcctcgtctgttttccagatggaggagagacaggtggtctccgtggtcatgacatcgactccgttccgataatcggtatccatggaggcgatacccgggcctacgaattccataactttgttttttacgtaaccgtttttaaatacggcgcctacgatggccagtgccacgtcgtgcggaccgacgcccggacccggttttcctgtcagatatatcgctacgacgcccggataggtgacgtcatatgtatcacgaagcagctgcttcaccagctcgccgccgccttcgcctaccgccatggtacccagggctccgtaacgggtatggctgtcggatccgaggatcatgcgtccgcagcctgccatcatttcacgcatatactggtgaatgactgcgatgtgaggcggtacgaagattccgccgtatttcttcgcggctgacagtccgaaaatgtggtcgtcttcattgatggtaccgcctaccgcacacagggagttgtggcagtttgtcatgacatagggaatcggaaactcggtgaggcctgacgcccttgcggtctgaataattccgacaaacgtaatgtcatgggatgccatggaatcgaagcgcagcttcaaatgttccatattgtccgcagtgttatgttccttcaggatcgaataggcaatcgtgccctttttcgcctcttcttttgttacgttctttcctgtcagagcgacaagcttttcggcttcctgttccggcaccagttccgtaccgtttaccaggaaagcacctccatcatacaatttaaccatatgctatctttcctctctctttttgtaaggtgttgcttcaccaacgtatttgaacgccggacgcatgatctttccatcatacatcttattctcgatattgtgcgccagccagcctgccatacgtgcgcagacgaagagcggcgtgtacatatcttccggtatctgtaacatattataagcgaatccgctgtagaagtccacattgtttgagagagtttttccgtttccggcgagagtttctttggcaactttttcaaatcttgtcaggaattcgtattcatcctcacgttttttctgctttgccagcttctcgcagcatgtttttaataagtcggcacgcgggtcggaaactgtatagacggcatggccgagaccgtatacgaggccggtattatcataaaattctttgtcaagaatccgcttaatcacctgcttgatctgtgcatcggtggcctttaagccgatttccttttcgatggcggagatcatctcgctgcagcggatgttggcgccgccgtgcttcggtccttttaaggagccgatggacgcggagatcgaggaatagatgtcggttcctgtggaggagatgacgacatttgtaaaggtagagttgtttccgccgccgtgatccgcgtgaatcatcagcatgatgtcgagtaagtctgcctcctgctcggtgaaggtgccgtcgcggcgcagcatgtagaggatgttctctgcaatggagtattcctccttcggatagtggatgatcaggctttctctgtcatagtagtgaatcttgctctgataggcgtaggcagccatggaaggaagcttagccagaatgctgattccctttaataacgtctggtacgggtccacgttgtcgggatcttcatcataattatagagagaaaggatactctgctgcagactgttcattaaattgcgggaaggggaacgaagcagattcttctccagaaactcatcgggaagcggataaaaatgacggagaattccggaaaactcgttcagttccttcttggagggaaggtatccgaatagcagaagaaatgtggtttcttcaaagccgtaccgtgcatttccttttccctttaccagatcgccgatttcgattccgcggtagaaaagcttacctggtacattgacctttttcccatcctgaatctcatagccgacaacgtcggatacacgcgtcaagccaaccctgactccggtgccatcctcgttgcggagacccttttttacgttgtgttccttgaataaatgatttggaatatccgtatagtttgaggatttaccaaatgtctgtgcgatgaagaagttattcatgcgatattctctccttttcctttagattcagtcacggcctgcataattttgcagaaaagcagcgcgaagtgatctccacgctgcccccattggcattactgaagtgaccgtttttatattgttcagtagtttaccatggaaaagtatcaaagtcaataccttgttataatcacaatcaaaatattgtgatacgtacaagatatgtttgtattaaccatacaaatgtgtgcgatagacggccttaatttttagaaataaaaatgaatcaataatattaaggaaaaagaaaggaaaagattctgacaacatactataatagaaagaaaagagtggtaacagccacagggaaaaggagcggcgccatgtacagtgattttggcttttacggaggatttacgcagttatttccgattttattcggagttatatttttgatcgttgcagtaatgatcgtagttaccctgattcgggggatctcgcagtggaattccaataaccactctccggtattgactgtggaggcgatggtgacttccaagcgtcaggaggtttcacaccggcacagcaatcagaacacgatggatacttatacaaattttacgtcttattatgcaacgtttcaggtcgagagcggcgaccgcatggagctgggcgtatcgggaacggagtacgggatgctggcggaaggcgacatgggcaggctgacctttcagggaacgaggtatctcagttttgagaggggacctctggagtcatagagagggatttattcccgcgagcaacgagtcaaacggacacgaggatgagagatggaaaaacgaaaaagaacaatcagaaaattgatgccggtcagtccttacgacagcaccggtctggaggcctggttttcggagctggccggacaggggctgtttgtcaggaagaccgggtattattttgcaaattttcaaagaaaagagccgggaagcctggtctataagctggagccttgtgaccagtaccgggatgagcaggaaaaggagctgacggggcagtaccgtctggcaggctgggaagcggccggtgatgtgtggcgaaagtttttgatattttcggctgtcagggagatggctgtaagtccggagatttccgtggaaatacgaagtgcaggcgaggcgtccctgaagaaaacggggtatggctgccttctgacgtgcgctgcggatggcgtactgacggcgctctggtgctggatgatcctgggccgatttggtttctggtatacggccaccatggcgacgcctttccttctctgtgccctgatggtctttctgtttggaatcaatatcttctggagaatgtccgattacatacagatccggagatatttaaaggggacaaaatgtggcgtacatctgccagaacgcaattgtcaaacacgccctggcagaggacgggccagatcgatctgttcagccgccgcggtaacctgcatctgcctcgtgtttatatgggcgggagagcagaagtcctggcataaggaactgagtgaggttcataccagtcttccggttccgcccattacggcggtttcgccggagagcagccccataagcggaacggtcacctatcattcttccatcgttgcaccggtacagtttcagatcgtccaggatggaccggatgcccagatgctccgtatggattatatggaactccgctttcccaggctggtgaagccggtcttcaagaatatgatgaaggatcagctgcagtggagcagcgctgagccggaggcggtatcttccgggctgtttgacaccgcctttgtggccgtgataaacgacagcatgcattatctcttcgtctccgacggacagaaggtagcagcagtgtgctatatcggccccggttatacagacgagtttttaaagacgattcacgacgccatggagacatggacgcagccggagctgtttaggcagtgatcagcgggtttccttcatattcctggaagccgtctgtttcatgggacggatcgaaaggatacatattaatatagtaagaacatcggccgcaggctgggcaaaatagatgccggtcacgcccagaagcctcggcagaatcaggataaagggcacgtaaaagagaccctggcggatcatggacaggaagaggccgaaccttgaggcgccgatggtctgaaaggtgatggtcatcatatagcagagcccaaacgccggatataaggcaacctgggatatcagcagccgggaaccgtattcgatcacggcgggattgctgttaaataatcggatgaacggccgggacagcgcgatatagactgcggccaccacgattgtcagaagcagggaggcggtgagggagaaacggacagactcatgaaaacggtcttcgttcttcgcaccgaaggcgtaggaagcgaccggctgatatccctgcataaatcccataatgacgtagcagccgatgagaatcagccgttggacgacaccgtaggccgcaatgattaaatcggcgtccggcatgggctttgcggcgatattggtcagcgatgtggccgctgcgagacagatctgaataaccgcggagggaattccgatcagtgtgaccgtttttatcatgtgaaagttgggcttaaaatagtgcggcttgattttaatgatggagcgtccgcctaaatagaaccacagcaggatgaaaaatgtgacaaactgagagaccgttgtggccagggaggctccctgcacgcccatacccaagccccagtcgaacatgaaaacagggtccagaactacatttagggcggcgcctgtgatgacggctatggaagaaattttgacggaagattccgccctggcggcacagttcaagctttgggccggcagattggccagcgcggcgataaacatccagaacgcgtagtccttagcctggggcagaaccgcgtccgaggcgccgaaggaacggagcagcggctccataaagaagagtccgccgacgcagagaatcataccgatgacaaccgacagggcgacgatggtcgtcaccgtagtgttggccccctcctggtccttcgcccccagctgacggcctgccagcacggcggcgccggcggaaaagatgttctcaaccgaaaccatgatcagaagcaggggcagcgtcacgccgacggcggccagagccgtgtcggaatgcagcatgccgatgtaggcggtatcgacgatattatagactgcctttgctaaaagggccagagtggcgggcaccgccagcttgatgatggccttcgaaggcttcatttctcccaaaacagatgcattcgttgttttttgactgtccattggattactcctttctctctacaacgccgtacaggaggatgcgcagcgccctgcggcagctttcctcgtggtcgcgtatatcgattttcaccgatccggtcatctggtatctggcattgatatagtcctgatactggcggaatgtgtccactacatcttccctcgataagtcggagcgcagagataccggctccagcatccggtttaagctgtcaatgttgaaacggtcgaacggggcttttttctcctgaatgaaagcctccagatgagcaggcggcataatgacggcatcacagaaaatcctctggtactggggattctgttcaaaaaagtccagtcttacacgaaaatactgctccagccgctcttcggcggtttggccttccatgttagtgtggctctgtaagtggccggtcagcatctggaagcactcttccacacaggctaagtataaatcgtcttttgttggaaaatagtggtagataattcccttggaaagcccctccccgttgctgatggtattaacagagctggctccatagccctgctctgaaaattctgccagcgcgctttccagaatgcgccgtctggtctgctgatttttttcttctcgtttcatgatttcgttctcctgaaaacaaatattgaccatatggtctattattacgataccacaaatagaccacatggtcaatattaatttgcaacaacggaaattgcttgaaaatgggggatgcaacgatttgttgcgtgacagtgcggcgctgtctgtggtatgttttttagagatggagaaggaggagcgcgtatgaacgggatcggaaaaaacataaagaagctgaggaaagagcgcgcgctgtcacaggaacagctggctgagcggctgcatgtgacgaggcaggctgtctccagctgggagacaggtaagaatcagccggatattgagacgctggaatccattgccgcggtatttgacacggatattctgatggtcttatacggacgatccagacaggaggaaagcggggaggagaagggggcacagagaaagcgctgtgtgagaaactgtctgatgtggggagccatagccctcgctgggcttgtggttcacctgatggtcaaagataaaattatggactggtattaccggttctgctacacggtcccggtttatttatttgcgctgcttgtgagacccttatgtgtttttgcttcggctgtggcatttatgaacgggctctgcctcatcggagatatccggatcaggcagaactggatcaggagaacggttttaggggtgtccatggccttccttttcctgtatctggcggcagcgtttctgtgtctggtacccgtggtgcagaatctggtacccgcatttctgcctgacccgggagctgtgtctgggtggatccgccgcccgccctttgttttttcatttattgttcggctcgtaacggcgcctgcgctgtttttacttcccgggatcggaatgtttcttggactccgccgataaagacgcggttagaaatatgggacagaagagaaggaatgtggtatactgacagcagggcaggcggcctgtgggagcagatctgccgcgcagtacgagtactcacggaaactccttgtgctcaatacctgaaagggagggaaaaccatggcaccagtgatcagaatgaatgcagcggctctgtgcagagtttcatgacaggcgaatctggcacagagcgtataaaaggaattgtaagcggcagaaataccgcttgattttatgaaacagatgtcgcctgagtggattctgcacttataaatggaatgagttacttttattttaatttataaggagagaatctatgaaagacagacaataccgtaactttatcattttctggttcagccagtccgtatcacagctggggagttccatgacttcctttgccttaatcatctggtcttacggcagaaccggttccgccatgtccgtgtcgcttatgacattttgtacatggcttccctatattgcggccagcatcgctgccgggccggtaatcgaccgttaccataagaaaacgatcatgcttctcgcggacctccttgcggcggtctgctctctgaccgtggcggcgcttgcggtctccgggaatctggtggtctggcacatttttatcgtcaatggaatcaccggcttcatgaatgcatttcagtttccggcggagacggtggcggtggggatgctggttccgaaggaaaagtacagccaggccagcggcttaaattcctttacatcatccttactcacggtggtaaccccggtgatggccgcatccttatcctcatttgcagggttaaagggtgtcatcgtctttgatctggcgacctttttgtttgctttttctgtcctgctgtttcggattaagataccggagaatgcgggagggacggagacagggaaaaagaaagagaagatctcacttcaggaatcgtggagggaggggcttcaatttctccgcggacacaaacagctttggtatctgatgatcagcatggcgcttatgaactttttttcacggctgacctatgaaaatattctttctcccatgattctggcgcggagcggccagaaccagatcgcgctcggcattgtcagcgggattctggggatcggaggcatggcgggcggtctgatcgtctccttcgtaaagcttccaaaggacagcatccgggtaatctttatatcgggaggcatctcctttctgctgggcgattttctgatgggagcagggcagaatattctcgtatggagcattgccggcatagcggccagcatccccattccttttattatggcggggcagaatgtgattctctaccggacgattccgcagaatatgcaggggcgcatctttgccgtgcgaaatgccatccagtactggacgattccgaccgggattctcctgggcggttttctggcggactacgtgtttgaaccgtttatgcgcgcggacgggggcattcagacggttcttcaccggctgaccgggtatggagccggctccgggatggcggtcatgtttctctgtaccggcattctcggaagcttgagctgtttcttctgttataaaaaaatgaaaaagaatggataaatgaagcacaggaagaagagcgcggtgatgcgttccgcttcctgtgcttctttttgtgccggtacaaagcataaaatattggttccttccacatcataagaaagctaccaatataatgatgcagaaaatacagccatgcaggaggaaatcagaatgagagaatataaaagagacagtgaaacaaactgcgaaacggataacagagcagaaaaccagaacggaaatggcggatcagacgagaaaaatatctcttccggagatacgagaaaagaccgcctcgatgagaagaagacggaaaaggatatcgagcagaaagaggacgaaaagctggaagagtacggccagatgaccctggatgacaattccaaaaagaggaaaattcatctgctctccatcatcggggaggtggagggccacgagaacctgtcgggaaacagcaaaacgacgaaatacgaccatatccttccaaagctggcagaaatcgaggatgatgattctgtggaaggcctcctggtgatactcaatacctcgggcggtgacgtggacgccggtctggcgattgcggagatgattgcttccttaagtatccccaccgtgtccctcgtgctgggcggcagccattccatcggcgtacctctggccgtctgcacggattactcctttatcgtgccgaccggaaccatgatggttcatccggttcgtatgacgggcatggtcatcggtgcatctcagacgtatgaatatttcgagatgattcaggaccggatcttaagcttcgtctcggaccacgcgacgatcgcttacgaccagttaaagcgcctgatgttaaacacggagatgctgacaagggacttgggaaccgtgcttgtaggcgaggaaacggtgaaagaggggctgatcgacgaggtgggcggaattaaggacgctctcagaaaattgtatgagatgatggatgaagtagaaggttagccgttgcaattctcccgatttttttgtatactgttaccaatggataaaagggggaagtattgtgcctgagacaacaaagaagaagacaacatccaagacgacagcaaaaaaaggtactaacgggaaggtcggaagaccgaaaaatacgacaagcaggcggaaagcggcggaaccagaaccagaatttatccggtcagaagttatcatcatcatatcatttgcggctgcggccattctttttttgagcaatttccatctgtgcggagtggtgggagatttccttcgcagtctgcaattgggtatattcggaggaatcggatacgtggcgccggtcctgatgtttgccggaacgtgcttttatatctccaaccggggaaatcccagagcaacatttaaactggcggcggtgatcctggcgcttatttcgctctgcggactcggcgagctcctgtttgggacaaggctgggcgccggcggaaagatcatggatatctacgtgacagccgcggccagcggaaagggcggcggcctgatcggcggccttctggcggaaggcctgatctccattatcggaaccgtgggcgcttatctggtgatcctggtgctgattatcatctccgcggtatgcattacggagaaatcctttgtgaacctcgtaaagagcggcagcggcaaggcataccaccatgccaaggaaaacatggatattcagagagagatccatgcggaacgcaaggaggaacggcgaagaatccgcgaggagcagaagctgcggggcgttaatttagatgcgacgaagctggaggcgccggacgagtacgactatgatatggaagacgaggccgcatacagcgcggaggcggaagaggacatcgatgtccacgcaaggcggcttgccgcagtgtctgccgtggaagtgacggagaacaggaagaatgcggctccggaggtacggccgaatccggcggatattttccgcggcagcattttcccgaagccgggtgaggcggaagccgcagcagaggaacgaaagcgcggcgaaaacatgggagcagccggcgcgttccagacggctgctcaggcagtggatgcggatctgccgcacgtctattctgctagtgaggattccgttccattcgatgccgatgacgccgttccgtttgtgacggaagacctttgggagagtaccgcccacctgcgttcggcagaaagtgacgccggggcatttgacgagtctgacgattacggaacgtcggagacattgtttgttaaaaaagaaacgaagacgctggaagagatggaggtcgcccgggaagagctgtatcccaccgacgaggacgataagggcgttaattacagcgacaccttctccataccggaggaaccgaaacgcgtcgttaccgcttccggcaaggtgatcgagaccgatacggaagcgcttcagaagaaggtcgaaaaaaagaaggccgagaaggccgagaaagaggaagcaggagatctcagcgtggtccaggagatcaaacagaaggaggaagtggtgaagaaggagtacgtcttcccgcctgtcacacttctgaaaaaaggaaagagctccggcccgttctctgataaggaataccgggaaaccgctatcaagctgcagcagacactgcagaattttggtgtgggcgtaactgtgaccaatatcagctgcggtccctctgtcacgcggtatgagctccatccggagcagggcgtgaaggtgagccggatcgtgggactggccgacgacatcaagctgagtctggcggccgcggatatccgtatcgaggccccgattccagggaaatcggcggtcggcatcgaggtgccgaacaaagagaacaacatggtatacttaagggatattctggaggcggaggagtttaagaatcatgcgtccaggattgcctttgcagtgggcaaggacatcggcggccaggtcgtggtaaccgatatcggaaagatgccccatttactgatcgcaggcgctaccggttccggtaagtccgtctgtatcaacaccctgatcatgagtattatctataaggcggaccccgaggacgtcaagctgatcatggtggatccgaaggtggtggagttaagcgtctacaacggtattccgcacctccttctccctgtggtcacggatccgaagaaggcctcaggagcgcttaactgggcggtggccgagatggatgaccgctataagaaatttgcccagtataatgtccgggatttaaagggatataatgcgaaggtcgagaatattaaagatatagaggatgaaaacaaaccgaagaagatgccgcagatcatcatcatcatcgacgagcttgcggatctgatgatggttgcaccgggcgaggtggaggattccgtctgccgtctggcccagcttgcgcgagccgcggggatacatctggtaatcgcgacccagcgtccgtcggttaacgtcatcaccggcctgatcaaggccaacgtgccatccagaatcgcatttgccgtttcttccggcgtggattccaggacgatcatcgacatgaacggggcggagaagcttcttggaaagggcgatatgctgttctatccatccggctgtccgaagcctgtgcgtgtgcagggcgcctttgtatcggatacggaggtctccgctgtcgtggatttcctgacagaacagggaatgacggcgaattacaacccggaagtggagaatcagattgcatcagcaccggcggccggcgacgcaaagggcggcggaaatgaccgggatgaatatttcgttcaggcaggtaaatttattattgaaaaggataaggcatccatcggaatgcttcagaggatgttcaagatcggattcaaccgggcggcccgcattatggaccagctggcggaggccggcgtggtcggtgaagaggagggcacgaagcccagaaaagtgctgatgagtgcagaggaatttgaggaattgctggaacagggttattaattacatagaaggaggacattcacagatgaaaacagatattgagatcgcacaggaggcagcgatgattccgattaaggaggtggcggcttcctacggaatcagtgaggaggatctggaactttacggcaagtacaaggcaaaactgaccgatgagctctgggaagaggtgaaggacagaccggatggaaaattggttttggttacagccatcaacccgactccggccggagaaggaaagaccacgaccacggtcggactgggcgaagcgtttggaaagatggacaaaaaggccatcatcgcgctgcgtgagccttccttaggaccgtgcttcggcatcaaaggcggcgccgccggcggcggatacgcacaggttgtgccgatggaggacttaaaccttcattttaccggagatttccacgctatcacctcggcgaataacttattagccgcgcttctggacaatcacatccatcagggcaatgctctgggaatcgatacccgtcagattctgtggaaacgctgcctcgacatgaacgaccgcgccttaagaaatgtggtagtgggtctgggcgcgaaagcggacggattcgtgagggaagaccattttgtcatcaccgtcgcatctgagatcatggcgatcttatgtctggccgatgatatgaacgacttaaaagaacgattaggaagaattattgtcgcatataattatgcgggagagccggtgacggccgcccagttaaacgcggtgggcgccatggccgctctgctgaaggacgccttaaagccgaatctgatccagactttggagcacacgggagcgatcgtacacggcggcccgtttgccaatatcgctcacggctgcaacagcgtgcgcgccacgaagacggccttaaagctggccgatattgtcgtgacggaggcgggcttcggcgctgatttgggcgcagagaaattcctggatatcaaatgccgtatggcgggcttaaagccggatgccatcgtgctggtagctacggtcagggctctcaagtataacggaggcgttccgaaggatcagctgaaggaagagaatttagaggctcttgcaagaggaatcgtgaacctggagaagcacatcgaaaacatgcagaagtacgatgtgccggttatcgtgaccctcaattccttcatcacggataccgaagcggaataccagtttgtgaagaaattctgtgaggacagaggctgtgagttcgcactttccgaggtatgggaaaagggcggagagggcggtatcgcccttgcggagaaggtgctctatacattggaaaacaaggagagccactacaaaccgctgtatccggacgaagccggattaaaggagaagatcgcagccgtagcgaaggaaatctacggagcggacggcgtgtcctttgcaccggcggcttcgaaggcattaaagaaaatagaggatatgggatttggcggacttcctgtctgcatggcgaagacccagtattccttatcggatgaccagacgaaattaggccgtccaagcggtttcctaattaatgtgagagacgcctatgtatcggcaggcgccggcttcgtggtagtactgaccggagcaatcatgaccatgccgggtcttccaaaggtaccggcggctaataatattgacgtaaataacgaaggagtaatcaccggattattctgatggaggatctatgaaattcagagagtggcttgaagagctggaatatgacgtaatttctggggatttggacatcgaagtggaggatgtcatctatgattccaggaaagccagggagcatgtggtgtttgtgtgcacaaagggaacgaaggtcgattcccacgagtttattctggaggtggtgaaggcgggggtaagggtcctggtggtggaacgccaggccgagattcccgccggtgtaaccgcgatccgtgtacatagttccagggaggcgctggcgctcttgtccgccgcccggttcggctatccgcaggagaagatgatcaccatcggggtgacggggacgaaggggaagacgacaacgacccatatgataaaggcgattctggaaagctgtgggaagaaggtgggcatgatcggcacgaccggtattgtgatcggcagtgaggtgacgcctaccatgaacacaacgccggaatcctaccagctttttgagagctttgaacgcatggcgcaggccggatgtgaatatatggtgatggaggtatcatcccaggcgttcaagatgcaccgtgtggatggcatccgttttgattacggcctgttcaccaacatttctccggatcatatcggaccggatgagcacgcagattttaatgaatacttatattataaatcacagctgctggaccgctgccggatcggcattgtgaaccgggatgacgagcattaccacgagattatcaaagacgcctcctgcgaactgacttccttcagcctggagcaggaagcggatttcatggcaaagcagattcactacgtgagcgagccggaatttgtggggcttgaattcgatgtggcggggcggtatgcgctggaggcccgggtgaatatacccggcagattcaatgtatataacgcgctggcagccatcagcgtatgcagctttttagatcttcccaaggaaaatgtgcgccatgcgctggagcatctgagcgtcaacgggcgcatggagatcgtgtatgcgtcgaagaagtgcacggtgattgtggactatgcccacaatgcggtcagcatggagagccttttggaaacgctgcgcgagtatcacccggcaaggcttgtctgcgtgttcggatgcgggggaaaccgctcgaaggacagacggtactccatgggcgacagcgccggaaggctggccgacttctccatactgacggccgataattccagatttgagaagaccgaggatatcatcgcggatatccgctcctcaatcgaaaagaccggcggtgactttattgagattccggaccggcgtgaagcgatcgcctacagcatgatccacgccagaccgggagatatgattgcggtcatcggcaagggtcatgaggattatcaggaagtgaacggcgtccgccaccatttttccgaccgggaagtggtgctggagattgcggcagaattggaaaaaagcgaatagagtgatgaaataaagtgaatagagtgatggaaaaaagatgccggaagtggtgatcccttccggcatttgctggagtatggctgattcaggcacactctaagtgaagacaggaaggaagacaggaagatggaacatatcacggttaaggaaattctggaggccacaggaggaaggctgctctgcggcagtgcggatacgccgctggaccatttaagcatcgattcccggaccatgaaaggaaatgatttattcgttcccctggtgggagaaaaggtggatgcccaccgctttatcgggcaggcgtttgataacggcgcggcggcaacatttacgagtgaacacgacgtgatggatgatagccggccatggatccgcgtggctgatacaaagagggcattacaggccctgggcgcctggtacagacgccgcctgaatcttcctctggtgggaatcaccggcagtgtgggcaagacgacgacgagggagatggtggcctgcgccctgtctgccaaataccgcgtctacaagaccccggcgaatcacaacagccaggtcggcgttccgatcaccatgacggagatctccagtcaggacgagatcggcgtgatcgagctggggatgagtgaacctggagaactgacgatcattgcgaacatcgcccagattcagatggcggttatcaccaatatcggaatcacccacatcgaacagctgggatcccaggaaaatatctaccgtgagaagctgagcattcaggatggtctgacggagcatggaattctgttcctgaacggagacgacgatctattaaagaagacgacggcgagagacggttttgaaaccatctactacggaactggagaaaactgtcattaccgcgcagccgatgtccatctggagaacggctatccggtatttacggcggtatgcggagaagagcgtgtaccggtccgcttaaaggtgatgggaagccataacgtggcaaacgccatggtgtcgctggcggtggcctctgtctgcggaattccgatgagggacgctgcggagcggctggcggaatttaccgggtttaagaaccggcagcagatataccatgtgggcggcatgacaatcattgatgatacctataatgccagcccggtatccatgaaggccggcctggaggtattaaattccatcgaaggttcgagagcccgggtggctgtcctggcggatatgaaggagctgggggcggattccccgcggttccactatgaaatcgggacttatatcgccgaaaatcccgtcgataagctggctgttctcggagaactggccagggaaattgcgcgcggcgtcagggaacaggcgcccgggatccgcgtctacgagtttatggaccgggagtccttgattgaatggctgaaaacggaactcagagaaggggatacggtgctctttaaaggctccaacagcatggaactgggaaaagtggcagctgtatttttggaaaaacagacaacggaaaacggagtatagatatggacagagaggcagtgatcagacaattttttcaggatgtgatcaagcagaatgaggccggattgaagcggtggttccgggaagatgccgtgatccggtggcactgcaccaacgagcagtttacagtttcggaatatatccgggcgaactgtgaatatccgggccgctgggaaggaaacatagaacgtatggagcagaaggaggataccgcggttaccgctgccagagtctggtgcacggaagacggcacttcctttcacgcagtctccttttaccggttcgatggggagaaaatcgcatccctggaggaatactggggagacgacggtccggctcccggatggcggcttgagaaaaaattaggccggccgattgatgagaaccggtgatgcacagccagaacggtaataccggaaactggaagaggaaaaatctgataaaaggcggcatgatatgaaacaggtggcattttatgaaaaggcagatgacgagctgcttcagtttgcagtaatcgctgcgaaatatcagggccggtgggtactctgcaagcataaagagcgcagcacatgggagttccccggcgggcaccgggaagcgggagagacgatagaagccgcagcggtgcgggagctgtacgaggaaacgggagccgcggagtaccggatggttccggtttctgtgtattctgtgactgaccaggcgcagtctggagagaagcaggcgaaatccttgggaatgctgttttatgcggagatcagccgttttgaccagcttcctcccgcgtttgagatggaaaaaattgagtgtttcgagaagccgccggataactggacctatccggagattcagccattgctttttcaacatctgcgtcaggctgctgggaaaacgatgatctgtgcggaaaagacggaaagtcttctgtacagaagggcgggaagccatgacagagagcttctgaccaggctgcggctggaggtgctgcgcgccgccaacggccttgaggaagacgtggatctgtcccggacagagctggaatcacgccgctattacgagacgtgttttccggaagacagtcacgccgcatggctggtctttgacggggaagaggtggttggaacgggagccgtcagcttttaccaggtgatgcccacttaccataatccttccgggaaaaaggcatatattatgaacatgtacacccgtccggactacagacggcgggggattgcgcacagggtgctggagctgctgacggcggaagcagagatgagacagattgatgctgtcacgctggaagccactgctgcgggacggccgctttatgaagccttcggattcactgcgatgcgggatgagatggagcttctgggcggaagtaaattctgagatacaggaaaggagaaaataatatggggaaaatggccgtattgattgttgatgtacagaaagcactggtggaggcacatccatacagggaagaggagtttttacaggaactggagaatctggcggatagcgcgcggaaggccggaactgaaattatctatgtcagacacgacggcggtgcaggagaccagctggagagcggaacggaaggctggaagattcatgaggcggtggaaccgaaaacgggagaacggatttttgataagagcttcaacagtgcgttcctggagactgatctggaggagtatttaaaggaaaaacagattaccgacctgattctcatgggtatgcagacggaatactgcatcgatgccacctgtaaggccgctttcgaactggggtacggcgtggtgataccgacaggcgccacgaccacgtatgacaacgagttcatgtccggggaagcgactgtgaggttttatgaagagaaaatctgggccggccgatttgccgatctgatgcctgcggaagcggtgctgggtctgctgggctgctgaccgcggcagccgccggatggacatgccggcatgcccgcctggctcactggctgcggaaataataatgacaggatgggaaggaagagatggaagaacagacacttgcagaactgctgtatgattctgcattttccgagaaaaaacagaggaaggggcgctcagaggagcagaagatctgggcctccttcttagagctgctgaaccaggaactggacgcttccggatgcggggcaaaggcggagacttacactgaatctgagccgtaccggcaggcctgcggataccaccgggactacggatactttatggtttcctgcggcgaccggggctccagctccatcacgatcctggaggaagaggcggaggcggcgaaaaaccgctttctggctttgataattgaaaaaaaggcgtatgattgggtagtgaaggtctcagagcaggaagaggccatctggaagtaccactgccggtatgactaccgcagactgtggttcggaaaggctctggagtggctggcgccggctgtggactgggcgttttttgcacagtgcgccgagcggtacatcgaactgctgaaccgctggtttgcgcgtcctcactgggagtacgactaccagatcagccgtatcattgagatcagtgaatcgagggagtattcggattccaaatacctgtaccgcatcgaaccggcaaaagagccggaccatttcagaatccggctggagccacagtttctggaagacggggacagcagcggtgctttttcgtttgaaatcgaaggggaggcgctggatatgcggcggctggaggaggaagtccttgtccttatggatcgggaagaagacaacatagatgcttactcgctggaaggcagatttctgtggaatatcggagaaaagctgccggttcaccgccgctatgataacctttacgaggatatctgcggctaagaagggaaacatgaaattatgaagatactggttcttggcggcacacgttttttcggagttcatctggtgaatacactgcttttacaggggcatgaggttgccgtggctacccggggaaatgcaaaaccgcgctttatcgccccggtggaagaaatccgggtggaccgcatccgggaggaatccatgcgcgccgcattttccggcagagaattcgatgtggtatatgatgatctggcctactgctccaatgacgtgaaaactgcgcttgagacagtccggtgcaggcggtatgtcatggtttcctccatctcggtttatgaactgaaggaaaatacgagagagacggattatgatccgtaccgggaaacgctcatctggggtgggcggagtgcattcgattacggaacgggaaagaggcaggcggaagcagctctggtgcaggcatttccggaacaggagtccgttatggtgcgtttccccgtggttcttggaagggatgattacacggaacgtctccggttttacgctgcccatacggcgaaggggattgccatgcaggtggaaaatgaaaactgtcccgtaagcttcatttccgcggaggaatgcggccgtttcctggcgtttctggccgattcatccttagaaggccctgtgaatgcggctgcgtcggggacgatcaccatcggagagatcatccgctatacggaagaaaagacggggaagaaggcagtcctgtcaacggagggggaagaagctccttacaatggatttccgggattttccataaatacggagaaggcggaaggcgcagggtatcatttttccggccttgacacctggatttatcggcttctggacttctatggggagatggaagggtaatccggcgttgacttttcttccttagaatcctataattagtaacatacaaacccgacttgcttcgatatgatgcgcctaagtcgggtcatttcatttcgaaacggcagcgtttcggaggtgcagactgccgcacggctgaatcattacaaacgcggcagccgtctgaagggctgccaaaattaagaagacaggaagttgacgcaatgacaaaacgatttgcccagatcatcatcgatatttctcatgagaaagtggaccgcacttttgattacagaatcccgccccagcttgaggaccggatttccgtaggcgttttggtgaagattccgtttggaaagggaaattctctgaggaagggctatgtggtcggcatcacggaccacgcggattatgatgcggataagataaaagagatcgacagtatcgtggaaggcagtgtttccgcggagtcgcagctgattatgctggcgtggtggctgaaggaacagtacggttccaccatgaaccaggcattaaagacggtgctcccggtgaaacagaaggtgaagccgaaggagaagaaggtcctgcgcctcctgatcccggaagaacagctggaggcattgacggcggaggcggagaaaaaaagctataaggcgagagtgcggctcttcaaggcattgaaggagaaccctttgatcccgtatgaggtagcgtcaggccagatgaatttatcagcggcaaccttaaagccggtgattgaaaaaggctatgtggcactggaatcggaggaaatcttccggaatcccgtaaaggacgcgggcagcagagtgaaggcggtggacttaaacggggaacagcaggcggctgcagacgcattctgtgaggattatgaagcgggaaaacgggagacgtatctgatccacggcattaccggaagcggcaagaccgaggtctatatggagatgatttccagagtcataagtgagggaatgcaggttatcgtcctgatccccgagatcgcgcttacctaccagacggtcatgcgtttctacggccggttcggaaaccgggtttccatcatcaattccagattgtcggcgggggaacggtatgatcagtttgagcgggccagaggcggcgatatcgatattatgattggtccgcgctccgcactgtttactccgttttccaggctgggactgattatcatagacgaagagcatgaaggcgcctataagagcgaggtagtgccccggtaccatgcgagggatgtggcggtgaaacgggcgcagatgcagaacgcttccgtagttctgggatcggcgacgccctccctggaggcgtacacgaaggcactccgcggtgaataccggatgttcagcctgcataccagagccaaggcggacagcaggctggccgatgtggctgtcgtggatctgcgggaagagttaaaggatgggaataagtccattttcagcagacggcttcagcagatgatcggtgaccgcctggagaagaaggaacagatcatgatgttcatcaacaggaggggctatgccaactttgtgtcctgccgttcctgcggagaggccatcaagtgtccccactgtgatgtgacgctgacgcttcataaggacaaccgtctggtgtgccattactgcggctattcgattcccatgccggataaatgtcccagctgcggttctccttacatcgccaatttcggagtagggacccagaaaattgagatgatggcaaagaagatgtttccgcaggccagggtcttgcgcatggatctcgatacgacttcaaaaaagggcggccatgaggagatcctgtcggcctttgcggagggggacgccgatattctgatcggaacccagatgatcgtaaagggccacgactttcccgatgtcaccctggtgggagtgctggcggctgatttatcgctgtacacaccggattaccgggctgccgagcggacctttcagctgctcacccaggccgcaggccgtgcagggcgtgacgcgaggcatggtgatgtcataattcagacatacaatccggagcactacagcattgtcacggccgcagagcaggattatgaaaccttctaccatcaggagatggcctatcgccgtctgatgaagtatccgccggtcaatgtgctgtttaccgtgcagatggcatcgaaatcagaggcagcgttggtggaggcagcggaccgcctcgcagcccatataacgccccaggcagacgaggaaaaagtccagatgatagggcctgtagacgcctccgtttacaaaattaatgatatatatagaaaaattttatatttgaaacaggaaaattatgatatactaattaaaatcagggataatatcgactgcttccaacaggagaaatcagagatatttaaaggggttgtggtacagtatgatttttcatgagcagtgcaaaaagtggcattaagatattttcgttgtgctcgcacataagaaaatatcttagtgacactttttatagggcgaagcccgtcaccgaacgggagcgcagcggacgtgaggtggtgcactgcggactcccggaacgcacaatcaaactttaaaaaatgagaggataaacaacaatggcaatcagaaaaataagaacaatcggagacgatattttaagaaaacactgcaagccggtaaaagaattaacgccgcgcctccaggatttaattgaagatatgttcgaaaccatgtacgaagcctgtggcgtaggccttgcagccccccaggtaggcgtgctgaagcagatcgtggtgatcgacgtagaggacgggaaccagtacgtactcatcaatccggtcatcatcgagacgagcggaagccagacaggcagcgagggctgcttaagcgtaccgggaaaatccggtgtcgttacccgtcctgaccacgttaaggtaaaggcgtttgactgtgagatgaaggaattcgaactggttggagaaggtctcttggcgcgtgccatctgccacgaatgcgaccatttaagcggcgatctcttcgtcgacaaggtggaaggcgagctgaccgatgtggaccaggaagaggatgagacagaggaaggtgaagagtaaaatgcggatcgtatttatgggaacgcccgacttttcagtgccggccttaacggcgctggtggaagcgggccatgatgtgattgcggtggtgacccagccggataagccaaaaggacgtggaaaattagtccagatgactcccgttaaagaaaaggctttagagtatggaattcccgtttaccagccggtgaaggcgagggatccggaattcgtcagtctgctaaaggagatgaagcctgacgccatggttgtggcggccttcggccagcttcttccaaagaccatcctcgatattccccaatatggctgtgtaaacatccacgcctccctgcttcccaagtaccgcggcgcagctccgattcagttcgcggtgatcaacggggaatccgtcagcggaatcactaccatgatgatggcgccgacactggatacgggagatatcctggatcaggagtctgttgctctcgatgaaaaagagacgggcggaagcctccatgataagctgagcgcgatcggaggacgtctgattataaaaacgctgaagaagctggaagacggaaccgccgtgcggactgtgcaggacgaagaaaagatgacttactttggaatgcttaagaaatccatgggagatatcgactggaatcaggatgcggcttccattgagcgtctgatccgcggattaaacccatggcccagtgcttacacgagctgggaaggaaagacgatcaagctctgggaggccgatgcactggaagaagagtatgagggagcctgcggtcaggttgtgaaaacaggaaaagactgtctgtatgtaaagacaggaaaaggaacacttgcggtgaaggaactgcagcttcaggggaagaagcgtatggataccggcgcgtttctgcgcggataccagattgcagaaggaaccgttttcgaaaggagcgtctgattcatgtattatggcggcttaatgggatattattttgatcccacatggattcttgtaattataggtgcggtgctgtctatggcagcatccgcaaaggtgaacagcacattcaacaaatattcaaaggtcaggagcatgacgggaatgacaggggaggacgcggcaaagcgcctcttaaactcacagggcatctacgatgtgaccgtccgtcccgtaaagggacagctgacagaccactacgatccgaggacgaagaccgtcaatttatcggagtcggtattccattccacctctgtggcggcaatcggcgtggcggctcacgagtgcggccatgccatgcaggataacgtgggatacgttcccctaaagctgcgcggagcgatcgttccggtggccaatatcggctcgcaggcggcgtttccgcttattattatcggtgtgctgatcggcggtatgggatcgcctctcgtgaatatcggcctgattctcttttcactggccgttattttccagctcatcacccttcctgtggagctcaatgcctccaggagagcgattacgctgctcgaccaggtcggtatacttggcggccaggaagtaaatcagacgagaaaggtgctgggcgctgcggcgctcacgtacgtggccgcgctggctgcttccgtgctccagctgctccgtctcgtgattctatttggaggacgcagagacaatgactaacggaaacagcagccgggaaatcatcctggatatactgctcgagatcctggaaaagggcggttacagccatatcgtgctgggccaggcgctgagcaaataccagtatcttgacaaacaggagcgggcctttatctcccgcaccgtggaaggtactgtggaatacacccttcagctggattacgtcattaattcttactccagcgtaaaagtaaaaaagatgaaaccggtcatccgcactctgctgcggatgtccgtttatcagattctctatatggaccgtgtgccggactccgctgtctgcaacgaggcggtaaagctggcgcagaaacggaaattcaccggattaaagggctttgtcaacggcgttctgcgcaatatttccagaaataaagaacaactgaaatggccggatgattctgtccgatactccatgccttcctggattctggatatgtggaagggtacatacggagaggagacggcggtttccatggtaaaagccttcttaaagcccagcaggacggcggtccgctgcaatttgaaccgggcttcgaagcaggagattatggaaagcctgaaaaaccaggttgttacggtggaggagacgccgctgtctgcagcggttctctatttatcgaagtacgattatttagagagccttgacgcgtttgccgaaggcctgatttcagttcaggatatgagctccagctttgtgggcgagattgcggacccgaaggaaggcgatctctgcctcgatgtctgcggcgctcccggcggaaagagccttcacgtcgcggataaactgaagggaaccggaatggtaatcgtccgtgatttgacggagcagaaggtggcccttatcgaagataatattgtccggtcgggctttaccaacatccgtgccgaggtgcacgacgcccttgtgccggatctggcgtgggaaggcagggcagacattgttctggccgatctgccgtgctccgggcttgggatcataggcaggaaaccggatatcaagtaccggatgacgatggaacagatggaggagctggcagctctgcagcgggagatcctctctgtggttcagtcttacgtgaagccaggaggaaagctgatttacagcacctgtaccattgaccggaaagaaaatgaagagaatgcggcgtggtttctggagaattatccgtttgacgccatgaatttagaaggaaagttaggagaaacactgaatgcggcctcgttgaggtccgggaatatccagctcttaccgggaatacacccgtgtgacggatttttcatcgcggcatttcagaaaaaataaggataatggaaaagacagatattaaatctctgaatttagaagaacttacggcgtttatcacagcctccggcgagaaggcgttccgggcaaaacagctctacgagtggatgcacaaaaagctggcccccggatacgaggagatgacgaatcttccgaagtccctcaaggaacggctgaaggaaacgtgtgactatacgtcgcttcagactgtggacgagaaaatatccgccattgacgggacgagaaagtatttattcggcctttcagacggcaatatcatcgagagcgtcttaatgaggtataaacacggcaattccgtatgtatttcctcccaggttggctgccgtatgggctgccggttctgcgcctccactctggatggcctggaacggaatttaaggccggcggagatgctggaccagatctaccggattcagtatctcacaggggagcggatctccaatgtggtgatcatgggttcgggagagcctatggataactatgacaatgtggtgaagtttatccgcctgctgacggatgagcatgggctgaacatcagccagcgaaacattacactgtccacctgcggcattgttccgggaatccttaagctggctgatgaggggctcgccatcaccctggctctctcgctccacgcgccggatgatgaggtgagaaagactctgatgcctgtggcgaaccgctataagctgaacgatgtgctggaagcctgtcatacatattttgagaagacgggaagacggctgacctttgagtacagtctcgtttccggtgtcaatgataatctggaggaagcggcggcgctggcggcactgatcaaggaccagcagggccacgtgaacttaattccggtgaatcccatcaaggaacgggattacgtgcagtcggacaggaaggccatagaggcatttaaaaatctgcttgaaaaaaatggaattaatgttactataagaagggaaatgggccgggacatccatggtgcctgcggccagcttagaaagagttttttatgtcaggaacaaaaagggagtgagaagacgctatgaaagcttgtgcattgacggatacgggaagagtgcgtacggccaatcaggattacgtatatgccagcgtggagccggtcgggagcctgccgaacttattcgtggttgcggatgggatgggcggtcatcaggccggagactacgcctccagatatatcgtagagaatctggtgtcgtatcttcagtatacggaaaattcccagattgttccgcttctgcgggagggcatattaaaggtcaacaccatgttatatcaggagtcgaaggagaaaccggaactttccggtatgggaacgactctggtggctgcggtggccgatgagaataccctttatgtggccaatgtgggagacagccgcctctatctcgtgagagacaggatcagacaggtgacgagagaccattcctatgtggaggaactggtttccctggggcgtctggagcgcggaagcaaggattataaggataaaaagaatatcattacgagagcagttgggacagaagataagctgttggtcgatttcttcgaggtaggactggagccgggcgactttattctcatgtgttctgacggactcagcaatatgctggaggacgtggagatggaggagattgtcggctctgatctggagctggaggaaaaagcggagaagttgatcacggtagccaatgacaatggcggtaaggacaatatagcagtggtactcgttgatccgcagattggcagggaggtaagcttatgattttgagaccagggacatttttacaggacagatatgaaatactggataagatcggttccggcgggatgtcagatgtgtacaaggccctgtgccataagctgaaacggcaggttgccattaaggtactgaaggaggaattcagttcagacagcggatttgtgagcaagtttaagatggaagcccaggctgcggccagactgtcccatccgaacattgtaaacgtatatgatgtcgtggatgagggaactcttcattatatcgttatggagctgatcgagggcatcactcttaagaattacatcctgaaaaagggctgtctcgacagcaaggaggccatcgggatcgccatccaggtggcgcaggggatcgcagccgcccatgagcagggaatcgttcaccgggatatcaagccgcagaatatcattatcgcgcgggacggaaaggtgaaggttgcggatttcgggattgcccgcgccgcatccactcagacgctcagcgctacggctatgggatcggttcattacatttcaccggaacaggcgagaggcggatacagcgacgcccgcagtgatatctattcactgggtatcaccatgtacgagatggcggccggacgggtgccctttgaaggggagaacaccgtcacggtggctctggcgcacttagaagacccgatcacaccgcccagctactacaatcaggagattccggtcggttttgagaacatcattttaaaatgtacggagaagaagccggagtaccggtatgggagcatgcaggaggtgatcgccgacttgcggcgcgcccttgtgacgcccgatgagaattttgtgcaggcgtcggctccgtccatggatacatcccagacggtgatcatcggagcgccggagctggagcagatccgttccggttccggccgcaggaatcagccggaaccgcagcagaaccggaacagccgctatggcaatgaaccggtgcgggaacgccagccggagcacaggagcagccggaataccggaaacgccggaggcccgtcgggaagaacgaagcggcgggaaccggatgaggagatcaatccgggaatcgaaaagcttctgacggcagcgggcatcgtggtggcggttcttatcgtcatcgtccttatcttcctggttaccagacttggcgggctgttccgttcaggaacacccaaggagacggagaccactgtggagactacgatacaggaggagacgactctgggtgaaaaacagaccaccatgcctgaggtcgagggactggcggaagatattgcgcggcagaagcttcgtgagaacggcggtctggacatgaagatcggcgattatgagttctctgataccgtgaaaaagggagatgtcattacccagactccgaaagcgggagagattgtagataagtactcggctgtatctgtggtcatcagcaacggaccggagcatccggagatcgatttaaccaccctgggcctggattcccttacagcggaggcggccaaatcgcttctggagggcaaaggctttgtcgtgaatgtgcagaaccagagcagcgatacggtagagtccggcaagatcatcagctacagcccggataaggcaaaggaaggggctgtgatcagcgtgatcgccagcacaggaccggcactgactaatccggtaacggttcctgatataacaggcaaaggggaagaggtcggagaggagatgctggccgatctgggcctggtttccggaacggtaacgaaggaaacctcggaagaggtgccggcaggcaccatcattcgtcagaccatcgcgcccaatacccaggtagagggcggaacggccatcgattacgtggtcagcagcgggtcggcggaacaggccaaatacaagtacctggcatccatcgagaaatcgtatccgctccagaatttaataggaccgggatccgccagcacccagctgaatataaagatccagctgaagcagacggtaaacggaaaagacgaggtcagggatctgatggggccggtgacgatcacgggagaccagcagcttccggtcgtcttcaagaacattgagggcgcatatggcgtgaccagcggtgaagtgcagattgtcaatgtggacacgggagaagtaatcaattcctatccggttacgtttgtccccattccacagtcataagggctattatatgacaggaaaaattataaaaggaattgcaggtttttattatgtggataacggaacagacgtctatgaatgcaaggcaaagggcgtgttccgcaataaaaagattaaacctctggtaggggataatgtggaatttaccgtgttgagcgaggcggagaaggaaggcaacatcgacaagatccttccacgcaaaaacgagctggtccggcctgctgtggccaatgtcgatcaggcgctggtgatcttctccatcacccatccggagcccaacttaaaccttctggaccgcttcctcgtgatgatggaggtgcaggatgttccagtgaagatctgttttaataagacggatttaacgggagacgaggagaggggccgtctggggaatatctattcctcggcgggctatcccgtctactttacaagtacctacgaaaacagagggctggaagcggttcgggagctgacagagggaaagacaacggttctggcaggcccttcgggcgtcgggaaatcttccatcacgaacctcctctttccggaggcaggcatggagactggaaagatcagcgagaagatccagagaggaaagcatacgacgaggcacagcgagctgtttgccatcgggaaggacacgtacatgatggacaccccgggcttcagctccatgtacttagaggaactggagtgcggaaacttaaaggattattttcctgaatttgcggcttacgaggaagactgtaagttcttaggctgcgtccatgtgggcgagccggtctgcggagtcaaggaggccgtgcgccagggggagataagcgaaagccgttatgacaattacaagcttttgtaccaggaattaaaagataaaaggagatattgatatgttcctattagcaccttccatcttgggagcagattttaaacatttggagcagcaggtatgcgaggccgcggacgcgggagcacagtacatccatcttgatgtgatggatggcgacttcgttcccagcatatccttcggcatgcctgtgatagccagcttgagaagctgtacagataaggtatttgatgtccatatgatggtccgggagccaggccgttatatcgatgccatgaaagaagcgggagccgacatcatcagcgttcatgtggaggcgtgtacccatttggaccgcacggtgaaccagattaaggaggccggtttgaaggccggagtcgtgctgaatccggctacgcctgtcgacgtgctggactgcatcctcgaccaggtggacatggtgctgctcatgaccgtgaatccgggattcggcggacagaagttcattccttatactctggaaaagatccgtgctttaaggaaaaaatgcgacatgcgggggctgtccatggatattgaagtggatggcggcgtgacctgcgataatgtgcgggagttgatggaggcgggtgccaacgtctttgtcgccggttccgcgatctttaaaggggatgtgacggcgaacacgaaggcatttttgaagatatttgaggaacaggaatgacgggccttattatcaccggcggaagcatagactgtgcattcgccggtgcttttttaaaggacaagacatttgacatggtgattgccgtggatggcggcctggcggctgtaaaacagctggatatcaggccggatgccattgtcggtgatttcgatacggtgaagggcgagcttctggaggaatacggtcagatagagggcataaccttcgaacagcaccagccggaaaaggatgagaccgatacggagcttgctctccgcaccgccatggaggccggcgtcagcgatatggttatcctgggcgccaccggcggcaggctggaccactccatcggcaatatccatctgctgtacgcgtgcctgcaaaaaggcgtgaaggcttccatcgtcgatgagaagaaccggctctacattttggatcagggaaagacttaccgttcctctgaaatctggggaaaatatatttccttcctcccccttaccgaggaggttcacgggatcacgctgaaaggcttcaagtatcccctgactaaccgggatatccggattggtaccagcctctgtatcagcaacgagctggaggcggagacggggactatcacattccgggatggagtgctgatctgcgtggagtctcacgactaagcgttgcagttcacggtaccacaggcctccgctttccggtctgccccggctggctcatgcggcctttccagttccggtttcgggcataagcacttctaaacgtgcagaatttttctaaaaaccagagaaaatgcccaaactcgctgcgctcagacaagtgggcatttcccctgaacgaaaaatcccgcgcgttaagaattgctaataccctgcaaagtcacaggaaaggccgcatgagccagccggggcagaccggaaagcggaggcctgtggtaccgtgaactgcaattactaaactggtatggcctaaaaaaacaaaactggatatttatatcactccaccctcatgctaagataggggacaagaaagcattggcatcaagggaggaaaaagaaatgaacagaacagacagtaaaattagcaaaattgccatgaccggattattcgcggccatgtcgtacgtggtctttacgttcctgcagtttaaaattacgcttccgggaggagacgcgacttccattcatttgggaaatgcggtctgtgtgctgggagcgcttttactgggcggcgtatacggcggcctgggcggagccatcggtatgacgatcggcgacttattcgatccggtgtatgtggtctatgcgcctaagacttttattttgaagctgtgtatcggcctgattaccggtttccttgctcacagaataggaaagatcaatgaatcccatgatcagaaacacattttcaaatgggtcctgatcgcttctgttggcggactgcttttcaatgttattttcgatccgcttgtgggatactactacaagctgctgatcctgggaaaaccggccgctgagctggcgctcgtatggaatgtgacctcgaccaccatcaacgcggtgacgtcggccatcgcttccgtcgtcatctacatgccgctgcggaacgcgcttctccggtcgggaatgggaggaattttacggatatgatatcagaaagacatcagaaaaaaattgcagtaatcaatgatttatcgggatatggccgctgttcgctgacagtggctattcccattttgtcggcgctgaaggttcagtgctgtccggttcccacctccattctctctaatcacaccggatttccggtgtatttctttgacgattatacggataagatggggctttatttagaaaaatggacggaactggggctggagttcgacggtattttcagcggctttctcggttcggaggcacagatcgggattgtcatgtccatgatccggcagtttcagggaaaggatacgctggtggtgatcgatccgatcatgggagaccacggaaaggcgtatcagacctacacgccggccatgtgcagccgcatgaaggagctggtgtgcctgggtgatatcgtcacgccgaatctgaccgaggcatgcattctgacgggccgggaataccgggacgaaggctggcacaggacggagcttttagcgatggcggaggagatccgggagatgggaccttccggagtcatcataacgggagtgaaggaaggtgcgtatctgaccaatgtcatcgcagagcaggggaaggaaggcgcgttctgccgttcgatgcgggtcggacgggaacggccgggcacaggggatgtgttctcggctatcgtggcggcggaggcggtaaaaggcgcttcgctgaccgatgcggcgaagaaggcggcacggtttgtaaagcgctgtattctaaaatcggaggagttaaatgttccggttcagaacggggtatgctttgaggaagtgctgtcggaattgataaaatggaaataaggggcttttctttcactgtaatttgtagtataatcaacggcagattatcatattgaggagaaaccaggaggaataccatgttagatttaaagtttgtaagagaaaatcctgaggctgtaaaacagaatatcaggaataaatttcaggataacaagctgccgctggtggatgaggttattgaactggacgagttaaaccgcgccgcaaagcaggaaggcgatgcgctcagagcggaacgtaataaactttccaagcagattggcgggctgatgggccagggaaagagagaagaggccgaagagcttaagaagcaggtgacagcggcttccgaccatctggcagagctggaggagaaagaacgggagctggacgagaagatcaaaaagatcatgatgaacatcccgaacatcattgatcctagcgtaccgattggaaaagacgacagcgagaacgtggaagtgcagagatatggcgaaccggtggtaccggatttcgagataccgtatcacaccgacatcatggagcgctttgacggaatcgatttggacagtgccagaaaggtagcgggcaacggtttctactatctgatgggtgatattgcaagacttcactcctccgtaatctcctatgcacgtgacttcatgatcgatcgcggctttacgtactgtgtaccgccgttcatgatccgcagcgaggtagtgaccggcgttatgagctttgctgagatggacgccatgatgtataagatcgagggtgaggatttataccttatcggtaccagcgagcattccatgatcggaaagtttattgataccattattccggaggaatcccttccgaagacacttaccagctattctccgtgcttccgcaaggagaagggcgcccatggcctggaggagcgcggcgtctaccgcatccatcagtttgagaagcaggagatgatcgttgtctgcaagccggaggagagcatggaatggtacgataagttatggcagaacacggtggatttattccgttccctggatattccggtcagaactttagagtgctgctccggtgacctcgctgatttaaaggtgaagtccgtggacgtggaggcttggtccccgcgtcagaagaagtacttcgaggtgggaagctgttccaacttgggcgacgcccaggccagaaggcttaagatccgtgtcaacggggaggacggaagaaagtatttcgcccacaccttaaacaacacggtagtggcaccgccgagaatgctgatcgcatttttagagaacaacttacaggcggacggaagtgtaagaattccggagcttttaagaccgtatatgggcggaatggaagcgattgttccgaaggataaaaagtaaagagatcatgatataacgcagcagatgtggccggttttcggaaccgcacaccagctgcgtttcttatagttaccctaaaggaaatggcagagaaaaacgctcttgctgtttcctttttctttttgtacatataattcgttgggttttcacaggattaccataaaagtatgaaaaaaaatcatactgtgaggaagagaaggcaggtggtatgcttaagacatgaaaagagagggggaaagcttatgaagcaatgggaagagtatcgtattccggcagaagaagtgagaaggatttccagaataccgatcacctgtctggaagaccagacatccgtattcagccgcatggcgctggagatggcggagaagattgaggacaacaaccgtcagggaaaacggacggtgtttatcattccgttcggaccgaccgggcagtatcccgtttttgtggacctggtcaacaccaggagaatcagcttaaagaaggtatggctgattaccatggatgactggctggacagcgacggcggactggtgggactggacaacatccattcgctgaggcggaagatgaatcaggtcctgtattcgaaaatcgacaagggcctggtgatgccggaagaacagaggatatacccggatcccggctggctggagagaatacctgatttgattgaagctctggggggagtggatatctgttttgcgggattcggcatcaacggtcatctgggcttcaatgagcctgcggatgtaagcccggaggaatttgcaaaactgcctaccagagttgtgagaatatcggaaaccaccaggacgatcaaggcttccaccggtgtgaacggagcgatggaggacattccgttttatggaatcacggtcggtatgagagagatgctgtgtgcagataaggtcagcgtttactgcttcagggactggcattccggggcaatcagacgggctggatgcggcaccgtgtcatccggttttccggcttccctgctgcagaatcatccgaacgccgccatcgtctgttctcccaatgccatagctccgtgctattaaaggaggagcggccatgaaatggattaaaataaaaaacaagagggtctggtctctcatttccctgattatgtgcctgatggtttggcagctgatctccgtgtcggaggcgggagccgtgttcgcctctccgaaaaagacgctgatggcatttatcaccatggcgaaaagcggggcaatctgggttcatatcggttacagcctgttccgggtcatcaccggttttttactgggactggccgccgctgttcccattgcattcctgatgggctggtataagactgtgcagtatctgctggagcctgtggtgcagttcatccggacgattccgccgattgcctatattccgctggttatcgtagcgcttggtgtggacgagtcctccaaaattatggtgattttcattgctacatttctcgtcatggtaattacgatttaccagggagttaaaaatgtcgattccacactggtaaaggcggccagagttctgggagctaacgacagggatatcttcttccatgtcgtggtaccggcgtcgtttccgtttgtgctgaccgctatacgcctcggtctttctgccgggcttaccacactgatcgcttcggaactgacgggagccagcaaggggctggggacaatgattcaggaagccagcatgtatttccggatggacgttgttatcatgggaatcatggtgattggaatcatcggtctggtgcttaacaagatcgtacatattctggaaaggtggctgacaggatggcaggaaactcatcaggcgacgtgattgtaaagattgatcatgtggagaaaatctatcagagcaggagcggcgaggtagtggccctaaacggcgtggacatggagatcagagaaaatgaattcgtctgcgtggtaggcccctccggctgtggaaaatcgacgcttttgaatatcatcgcgggcctggaaagaccgacgtcaggccgggtctgtgtgaagggaaaagaggtggtaaatccggggagcgagcggggcgttatcttccagcagtacgcgctgttcccgtggctgaccgtaaaaaagaatgtcaaattcggattgaagttaagaggtgtgaaggagccggaactatctgcgattgctgataaatatatccggctggtaggcctggaggagtttggagacagctatcccaaggaactgtcaggggggatgaagcagcgggtggcgattgccagggcctacgcggtgaatccggagatccttttaatggacgagccgtttggagcgcttgacgcccagaccagaacacagctccagacggaactgctagagacgtgggagaaggagaagaagacctgcttttttatcacacacgatgtggaggaggcgattatactggcccagcgggtggttatcatgagcgcccgtcccggacgggttaaggaaattgtgccggtaaatattccctatccaagaacgcaggaaacgaagatgacgaaggaattcctggatttaaaggttcatgtctggggacaggtgtacagggaatttttggaagtacggaaataagggtttacaacaattcacgagaaagctaagatggagaaggaggaaagaatatgaaaaaattaccaatcggtcttctgaccgtgatgctctgcggattactggcgggatgctccggaaatggcggaccacagcagaatgcggagatgaaggcgccggaagcaatgacagaggcaaagcagcaggcagaagcgaatccgacgacagaagcagccgctgcagaagcggcaaaaggccaggaaacagcaaaaccggagacggtaaagctgagagtcgcgtaccatccgaattttgggggaaacaacctttatatcaccgcggagaagaacggcttttttgaagaagaagggctcatagtggagccggttaaatttacggctggtccgcaggagattgctgccatggtggccggagatgtggatatcggttatattggccacggcgccacgtttttggccgtacagcgtcaggtaaatgtctttttgacggagtttttgggaaatggagatgaacttttaacgtataaggaatccggcatcacatcgctggaagatttaaagggaaaaaccattgccacagcgccggggacatcgggggaaacggtcttaaagctggctttggagaaagcaggcttaagccgtgatgatgtcagaatcgtcaatatggacgcagctggcatggtggctgcaattgtggccaagaaggtggacgcctgtacactctggccgccgcagaccagtgaagttcgaaagaccatgggggaagagaatgttgtaagactgaccacgatcggcgatttcagagaccagtttgcattcccggggcactgggtggtaacgcctaaatatatggacgcgcatccggatgtcatggtacgattttcaagggccatgctgaaggcgatggactaccgcaaggaacacccggaggaaacggcggaaaacgtagctgagtttatcgatgcgccgctcgatggtgttgtggcggagatgaacaacatcgatctgttcgatgcggattactgttaccaggttatgaccgacaaaacggcggcaaaatggtatgatgcgcttcagaatttatatgtacaggacggcaaggtggagaaaaccgtgccggtagaggaatggttctgccctcagtttgccaaagaagcgtacgaatccctgcataagtaaacggagaataaacgatgctaatcattatgatggccttaataggcgcggtagcactgattgtcgtagggctgcgccgggataagatatctcttcttattctggcgctgtgcggaagctttatcgccatgctcgcgggaatcgtgatctatacggccaagatcggcggcttctctcggaaccagcagattcttttgtttctgcttccgaatattcagcagtatttgcagtaccttcccattacccttgacgtgcagggctatgcagcagcagtgggaaggtgctgctttccctgcgttctgctcctgattgccctgaactactccatgagcaccctggtgcgcagacacataagaaaattacggattctggcttactttgtggtgatctggctggtctattattatccggcagtctttcggatgggagtgagggggcggtggaagctgcagcgcttcatgggagtgatggcgatggtgtggattatggcctgccttctgctggcgctctgtctgctgcttcatgagtaccgcagtatttccattccgtattttaagaagaacttccggtatatcctgctgtcgtatatcagtatggcattcctgtatattatctatggattacaggaccccgcgcagatttaccagtattacagcctggagtttttgtggatctggcggggaagctatacggcgggaatcatgtattccatctcctgggcggctctgattctctgctctgtattttttgtcatattgggttccgtcaatcttttgcgctatacacagattacctatcatcaggataaggaaagctctccccgtatccgttctgcggagaaccgggaaaccgtatcgctgcagagcagatttgatcagacgagccttggggcctctgtgtttgtgcacagtatgaagaaccagctgctggcaaaccggattctgaataagaaactggggcaggcgcttaaggaggattctccggatctggaaaaaatcaggggtgttgcggcccagctgaatcagctcaatgagtcgatggtaacacggatggaagatttgtaccgcgctatccgcacaaactccattctgctgacacctgtctccgtgcgtgagattgcggaggcggccatgggccgttttcatcagaaatatccggacagggctgccgcagtagcgctctgcgatgaggggctgatactggcagataaggagcacctggccgaggcggtctataatctgctctgcaacgggcaggaggcgatcgcggaagccggacgtgagtctgtggcagatctgcggctgactatccggagacagcgcctttataccgtgctggaggttcacgacaacggaaaggggatttccagaaccgaccggctgaagatctatgaaccgttttataccagcaaaaatacgagctataactgggggatgggcctctattatgtacggaatattgtaaagagccactacggcacccttaggatcgaaagccatccggagacgggtaccagtttttttatcatgctgccaagctacggaacggaagatacaggaaagagaggtggaagccgtggaaaggaaaataagaattctggtcgcagaggattttgacctccttcgtgaagacctctgtgaattccttgattctcaggaggacatggaggcagcaggcagtgccggcggaaaagaagagattgtaaagctggcgcggaagatggaatttgatctgattctgatggatatagagatggagtatttgacttccggaattgaggcggccgaacagatacggaatgaaaagccggaggcacagattatatttttgacggcccatgacacgaatcagatgatctacacggcgatgggggctggagctgtggattatatcgtcaagggatgcccggatgaagaactgcttttccacatacgcagtgccttttccggtaagccggtgatggaggccaaaattcagaaaatgctgatgagcgagtattccaggctgaggcgaagcgagcagagcctgttgtttttcattaccaatgtaggacagctgactcctgtcgaacgggaactggtgcgcctgctgctgcagaattacaaagtggggcagattgccgaacttcgcgttgttgaactggttacggtaaagactcagatcaagagcctgctgagaaaattcaactgcacgagaacaaaggaaattgtgaacctgatacatgaactgaaattggtgcatttgtttctatagccgtcagacggacaggggtaaaagccttccggggacggcttttgttgtgcagtccaatctgaaatctgaaataatgggcgcaaatatatagagaataatagcttcgtgtgatatactgattttatcccgcagaggctttttcgccggaagaactgctggattggaagaacattcacaggaaagacagaatcaataggataaggagaaaagaatatgacagcattcaaccattttaacttcaacgttctcgatctggaaaagagtcttgcattctataaagaggcattgggcctcatgccggttcgtgagaaggaggcctccgacggttcctttaaactggtttacttaggagacggcaaaagtgatttcacactggaactgacgtatttggcggacaggaaggaaccgtacgatttaggagaatgtgagttccacctggcgtttgccacggatgagttcgacgcgctctatgagaaacacaaagcaatgggcgttatctgctttgaaaatccgggtatgggaatctattttatcagcgatccggatggatactggattgagatcgttccggccaggggataagcggagtattttttcagacatgctatcatatagaaagaggaggggatcagatggaactacatgtcaatggcgtcaaattatattaccgcgtttcgggccatggtccggccgtgatcctcgttcacgggaatggggaagatcattccatttttgatgagacagccgcgctgctaagctacgattataccgtttacgccctggattcaagggggcacggaaagagctcggcggtggagactctgggctatcagaacatggcggacgatgtggcttcgttcattcggaagctggacatccgaaaaccggtgttctgcggcttcagcgacggtgcgatcatcggaatgctggtggctgagcagaatcccggcctgctgtcgaagctgattctctgcggcggcaatgcctatccacagggaataaaggaaaaatggtttcagctgttccgcctgatcagtcatttcgacagggatccgaagatccggatgatgttggtggagccgcagatcacagaggaagagttaaaacggattgaagagccggtgcttattctggccggagagaacgatatgatcaaggaagagcatacccgctatcttgcttcgaagataccggacagccggctcgtcattcttccgggggaaaaccacggcagctatgtggtgcacagcagaaaactgtaccatcttataaagaagtttcttgcagagaagttcccggcagagaagttcccagcagagaagtgcccggcagatctgacgggaaaatatggacagggaggaactgcacatgctgattgatttgacggtggaagtcacgccaaaggctgcggcggatgcccagggcaatgagaagaaggcgctgacgggtcatcttgggactcattttgatgtgatggaccgggagtttccgctggaatacgtgaagcgaaaaggactggtcttcgatgtcagccagatctccggccgtgatatcgagtccggagatatcttcctggaccgggtggaggcgggaatgtttgtggcatttttcacaggatttctggagcggaccggatatggaaccccggtttactttaaggagcatccgcagctttcggatgaactgatcgaccggctgctggaccggggcgtatccatcattggtatcgactgcgcaggaatccggcgcggtgcggaacatacgccgaaggatcagtactgcgcggaccggaatacctttgtggtggagaatttatgcggtttatccaggctcctggagggagaaatggccgcggaggccaccatttatacgttccctgtgcgttttaagggcatgacggggcttccgtgccgcgtggtaggagagcgataagtatttcatgctcaggagaataggatggacagacgaaagaaaataatatggatactgaccggcgcggccattctcgtcctggctgcggcagcacttctggtatggaggcacagaggcggaggcggggaaggcacaacgattcagagcacaaaggcacatccgctgccggaggcggtctattatctgcaaaaggatgaggagtgggcggccgacccgctgggagaatcccgctttaccatgggcagctccggctgtctcgttacctgtctggccacactttttgatctgtatggaaagtccgtgacaccgggagagctgaaccggctctttgcggaacagggcgtttacaacgcatccggggacgtaatctggggaaatatctcttccgtatatccggaagccacggtaacggtttataaaacggtagatgaacaggcgattgaggcggctctggatcaacagcagtatccgcttgtcagggttaagaatctgggagacggatactggcactgggtgctgctgctgggaagcggtgacgatggctacttatgcatggatccgctctacagcgaaaaggaggccagacccttaagcgcccatggaaataccgtgtattcctggcggcttgtgacgctgccggtgaaggaatagaaggaggcgcacatgacggcgaatacggaagtcacgaccatgctgggggatattacgaaggtggaaggcctggatgcgattgtcaatgcagccaattcgtctcttctgggaggcggaggcgtggatggagcgatccatcgggcggccggaaaggatcttttgttcgagtgcaggctgctgggcggctgtaagacgggacaggcgaagcttacgcgtggataccgcctttcctgcggccatattattcacacggtgggaccggtctggaacgggggatcgaaaggagaagccgagcttctggcatcctgttacagaacctccctggaagtggcgaaacagaacggaatcagaaggattgcatttccgtccatctccaccggaatttaccgtttccctgtggatctggcggcggtgacggcggtgagggaagtgagacgccggattgaagagtatccggacgccttcgatctgattttatgggtattgtttgatgaaaagacgaagagggcctatgatgcggccctggcagaataaggcgggaggctctgtgatggcgaagcaggaccagatacggacgtttctgtctgtaacagtggatttaaaaaaacaggtcccctatcaggagacggtgaagtgccttctggaattcctggaggaacaggggcttgctcccgggcggatgatgtttgcgtttcaggatgtgccggacacggctgcccctgtctttgcacggacggccacaggaaagatggggaaagcatttccgcagacaggtaagtatttaaggccgggtggtttagcaaaaccgcatatcacgactacgtctaatttcccggctgtaaagggactggcataccggattccggaaacggatgaagagctgactccggagctgtttactgcggtgacgaagaagattccgaggccgtattcgttttacagcgcggctgtcattctggattccattccgtggttcggaaacacgaatcctgtcccggcgctttcggacctgctggcagatgcagactgtgcgctggattccgttggaaataattacagtgcggactgtacgtattaccagtccgactgcatcgttcttgaccggcgtttcgactggggaacctcctgcaatccggttcatctgcggtttgaggtaactccgccgtccggtatggagggcatttcccccaatggcctgtccaaagcggatgagatagtctgcagatttgtgaaacggtacggcggacaggcagggctgcggcagatggtctgctgtttttctcctgagaggatggagcgcatctgtcaggcgtctatggaaatgaaacggtttctggaggcgcggagcagggagtttgggcggctttccatgcccagccgtattccttatgggatgggcgcatacctctgtgcctccgaggtagaggaagctggttttaaagttccgccctgcagccggtttttcaaaaaagttctggaaaacatgggatacatctggagacatccggatattggcggcctctgtgattttggaaagattacagagcatgggaattttgcacttaacgtgcggccctggtttcagaagaatcatctccaggtggccctggactgtgcaggttataatttttcgatcagccagatgctttttcgagacaggatctgccgctccttaacggatctggaattgtacgcagaggatttaaaacggatactctgcttatgggaggaaaccgtgataccggaaatcagacggttgttcggagacactcctaaatggtatatccacaccgtttccagtgattgttgcgtgggacgcgtgatcagaaatcagccataagggctgttgcgcggggcgtaaagaaaaaaaacagggtgtaaagaaaaaatacttgacacccataaaaaagtagtgtatgatagcacaggtgatgatatggaaaagattgcaagacagggcctgctgtatgatttttacggcgcgcttctgacagaacaccagagacaggtttacgaggacgtggtgctgtatgacttatccttaagcgagatcgcggaggaacagggcatcagccgtcagggagtccatgacctggtgaagcggtgtgacaggattctggaagattatgaagagaaacttcatttgatggaaaaattcgggaatacgaaacgtctggccagagagatccagagtctggcaggagaattttccagaacgggcgacaggaatctgctccggcgcatcgaagagatatcgggcgaaatcatcgacctggaggctcattagaaagggtagatcaggaggacattagatggcttttgagagcttatccgataaattacagaatgtatttaaaaatttaaggggcaagggacgcttgacagaagcggacgtaaaggcagccttaaaggaagtgaagatggctctgttagaggccgacgtaagcttccgggtagtaaaacagtttatcagcgctgtacaggagcgggcggttggacaggatgtcatgaacagcttaactccgggacagatggtaataaagatagtgaacgaggagcttgtcaagctgatgggttccgagaccactgagattcacttaaaaccggcgaatgagatcacgatcatcatgatggcaggtctccagggcgcgggtaaaaccacgaccacagccaagattgccggcaaattaaaggccaagggaagaaaacctcttctggcggcgtgtgacgtctaccggccggctgccattaagcagctgcagatcaacggtgagaagcagggcgtcccggtgttctccatgggagaaaaccacaagcctgcggacatcgcgaaggcggcggtggaacatgcgtcaaagaacgatcagaatgtagtaatcctggatacggccggacgtcttcatatcgatgaagacatgatgaacgagctggtggagattaaggaagccgtggaggttcatcagacgattcttgtagtcgatgccatgacaggtcaggacgcggtcaatgtggccggtatgttcaatgacaagatcggtattgacggagttatcttaaccaagctggatggcgataccagaggcggcgcggcactttcgatccggtctgtaaccggaaagccgattctgtacatcggtatgggagaaaagctgtccgatttggagcagttttatccggaccgtatggcttcgagaatcctcggaatgggcgatatcctttctctgatcgagaaggcggagagccaggtggatgaggagaaggcgaaagagctgtctcagaagctgcggaaggccgaatttgattacaacgatttcctggatcagatgaaccagattaaaaagatgggcggcatgtcgagcattatgaacatgatgcctggtatgggacagatgaaggacgtggaagtggacgaaaaggccatggaccgcgtggaagccatcatcctgtctatgacggataaggaacggacgaatccggacctcatgaagaacgcttccagaaaacagagggtcgccagaggcgccggtgttgatatcagtgaagtcaaccggatcgtcaagcagttcgaccagatgaagaagatgatgaagcagcttcccggcatgatgggcggcggtaagaagaagggcggattattcggcaagttcaagatgccgttttaattggatcagagaagttagcaaggcagttttactgcattgactatagatacgcagtatgcgaaaacacaaatattcaaggaggtgaatcacatggcagtaaagatgagattaaagagaatgggacagaagaaggctcctttctatagaattgtagttgcagattccagatccccaagagatggcaagttcattgaagaggttggttattacgatccgaacacagatccgagcgtaatcaagttcaacgaagagtccgctaagaagtggttagcaacaggtgctcagccaactgagaaggtaagcaagcttttgaaaatcgccggcatccagtagtttaataggaaagtcccccttacaaccgtttgggggaaagtggtgaagcatatgaaagaattagtagaagtaattgcgaaagcactggttgataatccagacgaggttgctgttaccgagtctgtgaaagacgacgaaatcgtccttgaacttacggtagcgccttccgatatgggtaaagtcatcggcaagcagggcaggatcgctaaggctatccgttctgtagtaaaagcagcagcttccaaagaagacaagaaggttattgtagaaattcagtagccaatacgtaaacgaagaccgccggcctgtcaggaagacggtcttttctatatcatggcaaagtgttatttgcaagggagaaaaatgatggaacaggtactgagagttggcgttatttcctctacacacggtgtcaaaggggaggtcaaggttttcccaacgacagatgacgcggcacgttttaaaaagctgaagcaagtgattctggatacgggaaaagaacagctgaaactggaaattgagggtgttaaattctttaaaaatatggttatactgaagtttaagggatatgacacaattgaagatatagagaagtacaagggaaaagacattcttgtcacgagagaccaggcggtgaagctggggccggatgagaattttattgttgacctgatcggtttaaaggtggtgactgaggacggggaaccgttcggcaccctgacggatgtcatcaagactggcgctaacgatgtgtacgaggtgaagacggcggaagggaaggaagtccttttgcccgccatccgggagtgcatccggaacgtggatttagaggcgggagtgattacggtccatattatggacggacttctggacttataaggaggaaaacatgaacttccatatactgactttatttcccgacatggtgttagacggccttcacaccagcatcatcggcagagccgcggagaatggactgatttcgattgaagctatagatatcagggaatactcgacggacaagcaccggcatgtggacgattatccgtacggcggcggcgcgggcatggtgatgcagccgatgcccatctgtgatgcctatgacgacctgtgtgacagaatcggaaagaagccccgggtgatttatctgaccccgcagggtactgtcttcagccagaagatcgcagaagagctggcagccgaggaggaactggtatttctgtgcggccattacgagggcgtggatgagcgcgccctggagctggtggccacggattacctgtccatcggtgactacgttctgaccggcggagagctgccggccatggttatgatcgactgcatttcccgcctcgttcccggcgtgctgaataacgatgtctcagcggagttcgagtcctttcacgacaatcttctggaatatccgcagtacaccaggccggaagagtataaaggcctgcgggtaccggaggttctgctttccggccaccataagaatatcgacacctggcgaagggaacagtccatcaaacggacgtatgagaggcggcctgatctgttaaaggatgcggtgctgtcgaaaaaggaacaggaatatctggagagtctggcgaagaagccggaaaatcaggatattcaggaagaaaattgcaaaaagggacttgcaatcgacaattctttatgataaaatattagacgttgtgacgcaaggagatggtcctctgttacggattacgtcagtatgaagtattaagaacatcaaatataatcaaggaggttcacacgatgaacgacattatcaagaatattgaagcagcacagttaaagcagacagtaccggagttccacgttggcgataccgttaaggtatacaacaagatcaaagagggaacccgcgaaagaatccagattttcgagggaactgttattaagagacagaacggcggcgcaagagagactttcacagtaagaaagaactccaacggcatcggcgttgagaagacatggccattacattctccttctgtagataacatcgaagtgatcagaagaggtaaagtaagaagagcgaaactgaattacttaagagacagagtaggtaaagctgctaaggttaaagagttagtgaaataattctgagacagtcagggggacaatgaaaattgtccctttcttaatagatgggatgtgcataaagagtggagttttataacagtgaagagaacaaccggatccgccatgtggttaactggattgtagacattaccgttgtgatcgcgtttgcatggtttattgtttatgcatatgggacccagattccgattgcaggacattccatgactccgcttctgcagtcggaggatgtagtactgatggaccgtctgtcttacgatttcgggaagccggatcgttttgacgtggtggtgtttgaacgggaagaccagaagatgaacgtaaagcgcgtgatcggtctgcccggtgagaccgtgcagattaagggcggtcagatttatatcaatgatgagttaattgaacagccggaaggagctggcagcatttcactggcaggtatcgcggagaacccggtaaagctgggggaagacgagtatttccttttaggcgataacagagacagcagcgaagacagccgtttttccaatgtgggcaacgtgagcggaaagcagattcagggaagagtctggatccggattgcaccattgacgaatctggagctgattcgttcgaaatagaggtagatgatgaatatacagtggtatccgggtcatatgaccaaggccaaaagggccatgaaggaagatatcaaattaatcgatttaattatagaactggtagacgccagagttccactttccagccggaacccggatattgatgatctcggagcgggaaaggcgcggctgatcctgcttaacaagtccgaccttgccgatgagcgctgtaaccttaagtgggccgcttacttccaggagaaggggtacttcgtggtaaaggtgaactccaagagcggagccggtctgaaggcgattaacggagtcgtgcaggaagcgtgtaaggaaaagatcgagcgtgaccggaggcggggaatcttaaaccgtccggtccgtgccatggtggtgggaatccccaacgtgggcaagtccacgtttatcaattcctttgccggcaaggcatgcgcgaagaccggaaacaagccgggcgtgacgaagggcaatcagtggattcggcttaataagagcctggagcttctcgatacccctggaattttatggcctaagtttgaggatcaggtggtgggaatccgccttgcgctgatcgggtcgattaacgacgagattttaaataaagatgaactggcgctggagctgatccgcttccttcagaagaagtatccaaacgtgctggaagacaaataccagacggatgcttccgatgcagtgggaattctaaaccagatcgcaaaggccagagcgtgcctttcaaaaggcggagagctggatcttgcaaaggcttcccgtcttctgatcgatgatttccgaaatggaaagctggggaagatcactctggagctgcctccggaattgccgtaacagttcagacggcgggaagatgagtcgtctgaactgctgacaattaccttcagagattacgaaagcggagtgaacctacgatgagaaagttaagcgaagaaaaactggctgctgagcgggaacgcttagagcttatgaaaagctacgaaaggcagtatgaggatagtgtcctcgtctgtggaatcgatgaggccggcagaggacctcttgcagggccggttgtggccggcgcggtgatccttccgcgggactgtgagatcctgtttttgaatgattcaaagaagctgtcggagaagcggcgcgaggaactgtttctggagatccaggagaaggcggtgagctttgctgtcggagtggtcggaccggagcggatcgatgagatcaatattcttcaggccacgtatgaggccatgcggctggcagtcagccagcttacctctgtcccgcaggtgcttttaaacgacgcggtgacgattccgggactggatatcccgcaggtcccgatcatcaagggcgatgcgaagagcgtttccatcgcggcgggcagcatcatggcaaaggttacgagggaccatatgatggcagagtacgacaagctgttcccggagtacggctttgcaaagcataaaggctacggaacggcggcgcacatcgcggcgcttaaggagatcggtccgtgtgccattcaccggaggagttttatcaggaattttgtggactgatggggaactgaatgaataagcgtgagattggcagcggctatgaagagatggcggctgcctatttgatagaacagggctataaaatcgttgcccggaatttttcgggccggcgcggggagatcgacatcatcgcgcgggacggggagtacctggtcttcgtcgaggtgaaataccggcgggatgagagacagggcagccccgcggaggcggtggactacagaaaacagcagcacatccgccgcgcagcggaatactatttatacaaaaaccgggtcagcgaggccatgccgtgccgctttgatgtggtcgccatcctcggagaccggatcacgctgatccgtgacgcattttgacgcctcgcaggatactggctgtgaatagccgctctgactatacaggaggttttattttatgaacaatatatggaagcgaaaacaggaactgccggtgcttgaatgccggatggcggatggcgttccctatctgtcttttccgatgctggagaagaccggcatcgtgcgccacgggttttccacccgcatgggaggcgtgagcaccggcgtgtatgctaccatgaatttcgcatttttaaagggggacgatccggaccatgtgcgggagaattaccgcaggatggcgaaggcgatcggcgtggatgaggagagaatggtactgtcctggcagactcacacgaccaacatccgcagggtgacggaagacgatgcgggcaaggggatcaccagggagcgggactatcaggacatcgacggcctgatcacggatgtgccgggtatgacgctggtgacgttttacgcggactgtgtgccgctctacttcctcgatccggtccatcgggccataggcttaagccattccggttggagaggaacggtggcccgtatgggccaggtgacgatggaagccatgggccgggagtacggctcgaagccggaggacattatcgcctgcatcggccccagtatctgtcaggactgctacgaagtgggagaggaagtggctgcagaatttcgccgggcattttcggaagaatactggccggaactgcttcgggagaagccaaacggaaagcttctgctgaacctctggcgtgccaatgagattgtccttctggaagcgggagtaaaggcggataatatccagattaccgatatctgtacccactgcaatccggactacttattttcccacaggacgatggggaatgagagaggaaatttagcggcatttctttctataaaagaatcgtaagaagcatttgccgaaacagaagaaagagtttggcaagccggactctcgcgccggaggatttttatttcacagcctggactcttctttgaaataaaagaacccctccgaaacggtcgtgataccgtctgaggggttcttgcatatgccgcctgagcagcctttcgggagactgcagctacaggatcgtctgatagtaatcgtatccgtcgctgtggcgttttttgagcagattctgaatcttttccgtaggggaaagcgcagtgctgatcgatacgtcgtggttcaaggaattgatgatggcggcgatatacttgctgatatcggcctccacataccattcgcggctcagcagctccttcgggcggtagcttaagttggtcgtcacgaccagatcgatgtattcctttgcatagtattcgtcgaacttgtccaggccgtttgtaaagagtccgaaggtacagcagacgataaccttttccgctttgcgttcctttaactccttggcagtgtccagcatgctctcgccggaggagatcatgtcatccacgatgagaacggtcttgccttccacggaagcgcccaggaactcatgggctacgatgggattgcgtccgcctacgactctggagtagtcccttcttttatagaacatacccatgtccacgcttaagttgttggccagatagacggcgcggtccatggcgccctcgtccgggctgatgaccatgagatgatccttgtcgatgggcagattcggataatggcgtaaaaatgcctttacaaactggtaggtcggcataaaattatcgaatccgtgaagcggtatcgcattctgcacacgcggatcatgagcgtcaaaggtgatgatgttgctgacacccatggcggtcagctcttccagcgccatggcgcagtcgagggattcacgcttgcttctcttgtgctggcggctctcatagagaaacggcatgatgacattgacacggtgtgccgtagccgagcaggcgcctataattcgctttaaatcctggaaatggtcgtccggagacatatgattggtataaccattgacggtataggatatgctgtaattagtgatgtccaccattgcaaaaatatcggtacctctgacggactctttgatgatgcctttggcttcaccgcttccgaaacggggacagtcgcagctaagaagataagaatcgacatcgtatccacggtagtggagatcggcctcgcgccgctttaattcctcgatatcgtttcgacggaaatctacgatatggtcgttgacttttcctgccagttcccggcagctctccagtgccgcgatctttagcggtgcaaccggcagctggtcattaaatacataatcatttgccatgataatgaaatcctccataaattaataacaggcagtcccgtaagactgcccagttctaatcttacatccatttataccattcttcgacacaatgcgtcaatagcaattcttacatttcatggaaaaaaacaaaaaaggctttctttacaaagattgataatattgttatgatagagaagataaaacagaagggaaacaacagaaaatatgagcagaaaaggacataaaataggggctgtggatcccgggtccatcgcggaggcgctggaactggagcctggcgactgcgtgttgtcgatagacggccatgagctggaagacattttcgattatgaatattatattaacagtgaagccatcgtcatggaggtcagaaaggccgacggcgaggagtgggagctggagatagaaaacggatatgaggacctgggaatcacctttgagaacggcctgatgagcgagtaccgctcctgccggaataaatgcgtgttctgcttcatcgaccagatgccgccggggatgcgtgagacgctgtattttaaggacgacgataccaggctgtccttcttgcagggcaattacgtgacgctgaccaacttaagcgattacgatgtggagcgcatcattaagttcaagctggctcccatcaacatctcggtgcagacgaccaatcccgagcttcgctgtgagatgcttcacaaccgctttgccggacaggcattaaagcggatcgatgagctttacaaagccggagtccccatgaacggccagatcgttttatgcaagggcttaaatgacggggaggagctggaacggaccataagagacttatcgaaatatctgccttatatggagagcgtttccgtggttcccgtcggactttccaggttccgcgacggactctacccgctaaagcccatcgaaagggaagatgctgctaaaaccatcgacttaatcgagcggtggcagaagaagctctatgaggaacacgggacccattttattcacgccagcgacgagttttacattctggcgggacgtccgctgccggaggaagaacggtatgacggatacattcaactggagaacggcgtcgggatgctgaggctcctggaagaggaggttgaatccgcgcttcaggaactgcagggagacggtgtggaggaggagatttccatcgccaccggacagctggcggccccgttcattgagcgccacgtgaattccgtccgcagaaaatacccgaactgcacgattcacgtgtatccgatcaggaatcacttcttcggggagcagatcacagtggccggactggtcaccgggcaggacctgatcggccagcttaaggataagcgtctggggtcgagactgctgcttccggagtgcatgttccgcagcggcgaagaggtgtttctggacgatattacccgcggcgaattacaaaaagctttacaagtaaaggtagatattgtaaaatcaagcggtcaggattttgtacaggccgtacttcatcctgtggaagagggaagcccttcctatgaaggatatgagttaaaggagatttcatatgagtaaaccagttgttgccatcgtaggccgtcccaatgtcgggaagtctacgttgtttaatgtattagccggagatacgatatccattgttaaggatactcccggtgtcacaagagacagaatctatgccgactgtacgtggctggacaagaattttaccctgattgatacgggcggaatcgagccggacagcagcgacatcatcctgtcccagatgagagaacaggcggagatcgccatcgcgactgcggacgtcatcgtcttcatcgtggatgtgcgccagggcctggtggacgcggattccaaggttgcagacatgctgcgcaagtccaaaaagccggtcgttctggctgtcaataaggtggacagctttgagaagttcggcaacgatgtatacgagttttataatctcggcatcggcgatccggttccggtttcggccgcttccagactcggtctgggcgagctgctcgacgaggtggttaaatacttcggcgagagcacagaagaggaagaggaggatgacagaccgagaattgccatcgtcggtaagcccaatgtcggcaaatcctccattatcaaccagctggtgggagaaaaccgcgtaatcgtatccgatatcgcgggaaccacgagggacgcggtggatacggagatcgtgcataacgggacggagtacgtctttatcgacacggccggacttcgccggaagagcaggattaaggaagaactggaacgctacagcatcatccgtacagtaaccgcggtggaacgcgcggatgtggtggtggtggtgattgacgccacagagggtgtgacagaacaggatgccaagatcgccggcatcgcccatgagcgcggaaagggaatcatcgttgccgtgaataaatgggatgccatcgaaaagaacgataagactatttacgaatacaccaataagattaaggatacgctggccttcatgccatatgcggagtacgtgttcatctcggcgaagacgggacagaggacgaaccgcctgtttgagctgattgacatggtgagacagaaccagacgcttcgcgtcgccacgggtgtgttaaacgagatcatgacagaagcggtagccttacagcagccgccgtcggataagggaaaacgcctgagactctactatattacacaggtagcggtgaagccgccgacgttcgtcatcttcgtcaatgataagaatctgatgcatttctcctacacgcggtatatcgagaacaagatcagggaagccttcgggttcaagggaacctctctcaagtttattgccagagagcgcagcggaaaggaacagtaggtatggaaagaatcatttgtctggcagcgggctatttatttggcctgcttcagaccggctatatttacggcaggctgaataagattgacatccgtaattacggaagcggcaactcagggacgaccaatgcgcttcgcgtgctgggaaagaaagcgggagcggttgtcttcttcggagactttttgaaggcgtttatcccctgtatacttgtccggatcctttttagggaccggccggagatcgcctgtctgctggtactttataccggtcttggcgtcattctgggacacaactatccgttctatctgaattttaagggcggaaagggaatcgcggccaccgccggtctcatcgtagccctggacttacggctgatggtggtgactctcctggcctttgtcctgattgtggctgtgacgaggttcgtctcactgggatcgctggtggtagccacgatttttctcgtgtggatgattgttatgggtagtaacggcagcttttctgtgcaggcgggatatctccctgagttttacatagttgcggctgtgatcagcgcccaggcattctggcgccacagggccaatattgtaagactggttcatggaaatgaaaacaaaataagttttggtaaaaaataaaaacgaggtgaagtatcatggcaaagattgggattgtcggttcaggaagctggggaatcgctttggctgttctcctgtataacaacggtcatcacgtatccgtatggtcggcgctgccggaggaaattacggagatgaagacgactgggcgccatcacactctgccggatctggttcttccggatgggatgatgtttacggaaagcctggaggaggtcatgaaggataaggacgtgctggttaccgccgttccttccgtctatgtccgttccacggcacagaagatgaagccttactgcagagaaggacagattattgtaaatgtggcaaagggaattgaggaatcgacgcttaaaacgctttccgagattctggaggaggagcttcccatggcggatgtcgcggttctgtcgggacccagccacgcggaagaggtgagcaaggggcttcccaccacctgcgtcgcaggcgcccacagcaaaaagactgcggagtacgtccagtccgtcttcatgagtgaggcgttccgtgtctacaccagcccggatatgcagggaatcgaactgggtggatcgcttaagaatgtcatcgccctggccgccggtattgcggatggactgggatacggagacaacacgaaggccgcgctgatcacgaggggaattgccgagattgccaggctgggaaccgctatgggcggtaagttccagaccttctgcggactgtcgggaatcggtgatctgatcgttacctgcgccagcatgcacagccggaaccgccgcgccggaatcctgattggtaaagggtataccatggaagaggccatgaaggaagtaaagatggtggtggaaggcgtctactccgcgaaggcggcgctgaagctttcagaaaaatatgagatcgacatgcccatcgtggaacaggttaatgcaatattattcgatgataaaccagcctccgaggcagtaaaaggcttgatgctgcgggacaaaactatcgagagctccgaccttccatggtaaaatatggatggatgattgaattttgaaagaatatatggaaattagttgacattttaaaaaagccatcttattatagagactatgtatatatagtcataggaactgtatatatgaatttcaaaattcaagaggaggaatgaattatgaaaaaaacaacaaagaagctggtaagccttggcctggctgctgttatggctgcatccttaacggcatgcggcggcaagagtgacaatggcgcgacaacggcagccacagcggaaacgacagctgcagcggatgccggagcagctgaccagactgcaggaggttcctttaagatcggcggaatcggaccgattaccggaggaactgctatttacggacaggccgttatgaacggcgctgaactggcaatcaatgagattaacgcggccggcggtatcggcggtgcacagatcgagtacaatttccaggatgacgagagcgacacagaaaaagcggtcaacgcttacaacacattaaaggattggggtatgcagatgttagtcggtacggttacttccgcaccgtgtatcgctgtaggcgcagagtccagcaatgacaacctgttccagctgacaccgtcaggttctgctgtggactgtgcaaagtttgacaaccagttccgtatctgcttctccgatccgaaccagggtgctgcttcggcccagtatatcggcgagaacaagctggctaccaaagtggcaataatctatgacagctccgatgtttattcatccggtattcatgacaagttcatcgcagaagctgctaaccagggctttgaagtggtagccgatgaagcgtttaccgctgacaacaatacgaacttctccgtacagattcagaaggcacaggacgccagcgcagaactggtattccttccgatctactatcagcaggcatccttaattctggtgcaggcaaagcagatgggatacgaaccggatttcttcggctgtgacggcctggatggtcttttaaccgtggaaaacttcgatacatccctggcagagggcattatgctgctgacaccattcgctgccgatgcacaggatgacttgacaaagaatttcgttactacatataaagagaaatacggcgacataccgaaccagtttgctgccgatgcctatgatgcagtatatgcgatcaaggctgccggagaaaaagcgggcattactccggatatggatgcttccacaatctgtgacaagttaaagacagccatgacagaggtttccgttgacggattaaccggcttaggcatgaagtggaccgctgacggcgagccggagaaggctccgaaggctgtaaagatcgtagacggcgtatacaatgcaatgtaagtttatcaagtaaatactgcttggtatatgacccaatggagggtcgtccagaggacgaccctcttcttttcaaatccaatacccgcggcagcggggtttttgacccctgcggcagccgtcaaatggacgcggcagcgtatccgtttggttcgctgctcgcgggaataaacaacgaatgaggtgcgatgatatgatgagtttcatatcctattttattaatggtttaagcctgggcagtgtgtatgcaattattgctctgggatacaccatggtatatggtatcgccaagatgctgaatttcgctcacggcgatgtcatcatgatcggaggatacgtggtattcaccgttgtcagcacgatggggcttccaccggctgttggcattcttcttgctgtcattatatgtacggtactcggcgtaaccattgaaaaggtcgcatacagacctctccgcatggcttcacctctggctgtcttaattacggcaatcggtgtcagctacttacttcagaacatcgcgctgctcgtttttggctccaatccgaaatcctttacatccgttgtaacgattccggctttgaagcttgccggcggaagactgacgatctcaggagaaacgctggtaaccatcgtctcctgtatcgtgattatgattgtactgaccacgtttatcaagaagacgagggcgggacaggccatgctggctgtctccgaagataaaggggccgctcagctgatgggaatcaacgtggacggaacgatcgcgctgacgtttgccatcggttccgcattagccgccatcgcgggtactttactctgttccgcatatccgaccctgacgccttacaccggttccatgccgggaatcaaggccttcgtcgccgccgtattcggcggaatcggctccattccgggcgcttttatcggcggcctgcttctgggcgtgatcgagaacctgagcaaggcatatatatcgtcccagctttccgacgccatcgttttcgcagtcctgatcattgtacttcttgtaaagcctaccggtattctgggcaagaagattaacgagaaagtgtaggtgggggccatgggaaaaagtggaaagacgaagagtctgcagataaataaaacaacaagaaataatttagtgacctatgggattgtaatagcagcctatattattgtagagatcctgataaatggggggcacttaagcagcctgatgaagggccttctggtgcctctctgtatctatacgattatggcgatttctttaaacctgacggtaggcatactgggggagctgagcctgggacacgccggtttcatgtgcgtgggcgcattttccagttctctgttttccatctgtatgctggatgcgattcccagtgtgggagtccgctttacactggcgattctggtgggcgctgcggccgcggctgtagccggcatcatcgtgggaatcccggtattaaggctgagaggcgactatctggccattgttacgctggcattcggtgagattatcaagaatgtggtcaatgtcatctatctgggaaaggatgcgaatggcatccatgtctccatcaagaacgccatggcgcttaatatggcggaagacggccagattatcatgaacggcgcccagggtatcaacggaacgccgaagaacgccacgtttacggtgggaattatcctgatcctgatcacgctgtttatcgtcctgaatctgattcattccagatcgggccgtgccatcatgtcggtgcgcgacaaccggattgcagcggaatccatcggaatcaacatcacgaagtacaagctgatggcgtttacgatatcggcttctctggccggtgttgcgggagtcctttattcccacaacttatcggcactgacggcgacacagaagaacttcggatacaaccagtccatcatgattcttgtattcgttgtgctgggcggaatcggcaatatccgcggttccatgattgcggcggtgatcctgacgctgcttccggagctgctccgcggactcaatacgtaccgtatgctgatctacgccatcgtcctgatcgtcatgatgattttcaactggagtccgaaattcatcgatttcagaaaacgtcattccctgagacggtatttccataaaaacacggcagataaggaggtttcataagcatggcattacttgaaattaaaaacctcggcatctctttcggcggactgcgcgccgtggatgatttcagcataaccatcgagaaaggccagctctatggcctgatcggccccaacggcgccggtaagacgacgatattcaacttgctgaccggtgtgtataagcccaatatgggaacgatccagctggacggcatgaacatcacgggaaagaagaccatggagatcaaccgcgcgggtgtggccagaaccttccagaatatccgtctgtttaaggaactgaccgttctcgacaacgtaaaagcaggccttcacaaccagtactcctactcaactgtagccggaattctgcgccttcccaagtattttaaggtggagaagaccatggatgagaaagcggtggagctgctgaaggtgtttgatctggataaggaaaaggattacctggcttccaatctgccctacggcaaacagcggaagctggagatagcccgtgcgctggcgacgaacccgaagcttctgcttctcgacgagccggcggccggcatgaaccctaacgagacgaaggaactgatggataccatccggtttgtccgcgataatttcggcatgaccatccttctgatcgaacacgatatgaagcttgtctccggtatctgcgagaagctgacggtgttaaactttggtcaggtgctcgcccagggcaatacggcggatgtgttaaatgacccggaggtcatcaaggcatatctcggagaataggaggagacaggcatggcaatactggaagttaaaaatctggaagtatattacggcgtcatcaaggcgttaaaaggcatatcctttgaagtaaatgaaggggagatcgtggccttgatcggagccaacggcgcgggaaagacgacgacgctgcacacgatcactggtcttttgaaagcggcaggcggctcgatcggctttgacggacgcgatataacgaaggtccgcggggacaaaatcgtcggcatgggaatggctcacgttcccgagggcagacgcgtattcgcggatctgaccgtgttcgagaatctgaagctgggcgcttatacgagaaaagacaagacggagatcgaagagacgctgcagatgatctacaagcgctttccgagacttctggagcgtaagaaccagccgtccggtaccttaagcggcggtgaacagcagatgctggccatggggcgcgcgctgatgtctcacccgaagctgatcgtcatggatgaaccgtccatgggtctgtctccgatctacgtaaacgagattttcgacattattcaggagatcaacaagtccggaaccacggtgctattggtggagcagaatgcgaagaaggcgctctccatcgctaacagggcctacgttttagagacgggtgacatcgttttaagcggcgatgcgaaggaactgatgaatgatgattccgtgaagaaggcatatttaagtgaataggatgaaggagcggccattgagccgattatgggacaacagactggtaaaaaacagattcggacaggtccggtccgggtggattatcctgatcgcaatggcggcttactatctactgtcttttgtctccaatattgtgatcatagaggtactgagaaagattttgattgccacaggcgatatcaatccggcaaccggagaggtttccagcctggtggactggttcaatgacgtctcactgcctgttgcgtttcagatacttacagaggttcttatgctggcagtaccgatcgtcatatggcgcctggtgatgaagcattcggtccgggagatgggactggattccttacactgtaagcagaggagaaaagacggagctgcaggtatgctgctgggaattgtaaactgctctgtcatctttcttttggttcttacaataggaaagggccgtatcgtatcagacggaattacggtctcggggctgaccttctggtgactggtcacttttgttttggtggggatcgcggaggaagcgctgaaccgcggatttttaatggctgttcttcggaggtgccgcaatgtacctgttattatgttcgtcccctccgtgatttttggactgattcatctgagtaatccgggagtaacgtttttttccttttcaaatatcgtgcttgtcgggatactcttttcctatatgttttttaggtcgggttccatatggatgtgtatcggatatcacattacctggaatgtctttcaggggctggtctacggaatgcctgtcagcggcctccagacccccggcatcatcacaacacagtatatggaaagcaatcttctgaatggaggagcctttgggatcgagggaggcatactgaccaccataatgaccctgctcagctttctgtttgtctggtattattaccggaattcaaactatgatttcttaagcgataaagaaaagccggaaacgcttcgctgattcatgagaagtaagccccagggacgaaagaacctggggctttccctgtggagggaagaacgaaacatcaaaaaatcttaaaaagacttgctggaatattaagtgatcccccgcatatattataacagcacagaagggggtatctttatggacaattttgatgtatacagtgatattaaagcccggaccaatggagagatttatataggcgttgtaggaccggtgcggacgggaaaatccacctttattaaacggtttatggaactgatggtgctgccggaaatggtggatgagcatcagaaaacacagacgagagatgaacttccgcagagtgcggccgggaagacgatcatgacgacggaacccaaattcataccgaaggaagcggctgagatccggctgggcgatgagattgaggcaaaggtgcggctcatcgactgcgttggatttatggtcgagggagctgccggacacatcgaaaacgatgaggagcgcctggtaaagaccccgtggtttgaatacgagattccctttacgaaggccgcggagatcggaacgagaaaggtcatcaacgaccattccaccatcggtgtcgtgatcacgacggatggcaccatcggggaactgaaacgccccaactacatagccgcagaagagcggaccattaccgaattaaaggagcttggaaaaccgtttatcgtccttttaaactccgtaaggccgtattccgatgagaccacggccctggccaaggatatgagggagaaatacggcgtgaccgttatgccggtgaactgtgaacagctgaaaaaggatgacgtctatcatattctggaacgcgtgctgaaggaatttccggttacggagatggatttctatatccccaaatggctggagatcctgcctgcaagccactggctgaaatcccagattattcaggccgccaaggacatggtgaaaaaggttacccacatgaaggatatcacgtcggatctgtttgacggtgcggccgagagtatccgggccgtaaaggtacagaatatgaatatggcggacggaagcgtttccatgggcatggacgtggatgacagctattattaccagatcttaagcgactacgtgggaatccccattgaaggcgaataccagctgatgcagaccttaagcgatcttgcaaagatgcgggcggagtacgaaaaggtgaaccaggccatgagccaggtgcgcttaaaagggtatggcgtcgtgacgccggaacgctcggaaattatcctggatgagccggaagtgatcaagcacggcaacaaatacggcgttaagatgcgggcggaggcgccttccatcaatttgatcaaggcccatatccagacggagatcgccccgattgtcggcagcgaacagcaggcggaggatctgatcgcctacatcaaggaaaatgccagagagagcgaggaaggcatctggaacaccaatatttttggaaagtccatcgaacagatcgtggaggatggaatctccgcaaaagtctcccagcttacagaggactgtcagttaaagcttcaggatacgcttcagaagattatcaacgacagcaacggaggaatgatctgcattatcatataatatgagcatgaatggcagaagaggaggatgaggtctttcacgaggtttcaatttatgctataatagaaaaatgaccgacagaagaaaaataaggagggctttcaatgaaattaatgttcatcggtgcggaccatgaggttaccggcagctgccactatttagaagccgcaggacttaagattctggtggactgcggtatgaagcagggtgtggactattttgagaatgcagagcttccggtgagctattcggagatcaattacgtgctcctgactcatgcccatatcgaccatgccgggatgcttccgtttatctatgcgagagggttccgcggagaaatcatcaccaccgaagccacagcggatttgtgcaacatcatgctgaaggacagcgcgcatatccaggaatcagaggcagagtggaagaacaggaaggccagacgagccgggcggcaggaagaagtgccgctgtatgaaatgaatgatgcggtaggggtgttaaagcagtttagcccctgtaattatgatgaaataataaaactggaggagggccttaccattcggttcaccgatgtcggacatttactggggtctgcctccattgaggtgtggatcacagagaatgatatctcaaagaagatcgtattttccggtgatatcggcaacaagaacaagccgctgatccgggatccgcagtatatccaaaacgcggattacgtggtaatggaatgtacctatggcgaccggcttcacggccggataccggaccacgtttccatccttgcggatattgtccagaggacgctggaccggggcggcaatgtggtgattcccgcatttgctgtgggcaggacgcaggagcttctctacatgttccgcatcatcaaggcggagcacatggtgaagggccacgacggattcgaggtctatgtcgacagtccgcttgccgtcgaggcgaccaatgtgtttaaggataatctgacggactgttacgacgaggagacgaaggcgctcgtcatgcaggggattaacccgatctcatttgcgggactgaagctctccgttaccagcgcagaatcgagagatattaatttcgacacaaaaccgaaggtcatcatctccgcggcgggcatgtgcgacgcaggccggatcaggcaccatctaaagcataatttatggcggcctgaatgtaccatcgtctttacgggatatcagtccatcgggacgttgggcagaagcctgctggaaggcggccgggaggtgagactgttcggtgaaaccattcatgtggaggcccacattgaaaagatggatggaatgagcgcccacgcagatatggaagggctgattcagtggctgaatgcgtttgaggagaagccaggggaagtatttttggtacacgggaatgacgacgtgtgcgattcgtttgggcaggttttaaaggaagagtatggatatcaggcggaggcgccgttttccggctccgtttacgacctggcctccggcagatggctggagcagagggccggagtcgtcgtgacgaagacggtggagacggcgaagcgggcggtaggcgtctatgcgcgtctgctggcagccggagagcgcctgctgtcggtgatccgccacaacgagggcggagccaacaaggatctggcaaaattcgcagaccagatcaattcattatgcgataaatgggacagatagctaggagagtgacataagatgggaaaagtactattgtttacagatggagctgcaagaggaaatccggacggacccggtggttacggagctgtgcttcagttcacggattccaaagggcagctccatgagaagacgctgtcggccggatatgtgaggacgaccaacaaccgtatggagctgatggctgcgatcgcgggactggaggcgttaaaccggccctgcgaggtggagctgtattcggattccaagtatctgacggatgcatttaaccagcactggatcgataactgggtgaagaacaactggaagcgcggcaagagcggcccggtcaagaatatcgacctgtgggagaggcttttaaaagccatcgaaccccaccgcgtcaccttctgctgggtaaagggacatgccggccatccggaaaatgagcggtgtgatacactggcgaccactgccgcggatggggacaacttaatggtggatgaaggcctgtaaaacttacgtatctcttacaatctcttactaattaacgtaccctatttcctttcttttttatttatgatatggtaattttatcaaagtatgttaggatgataatcatgaataaaaatagaggaatctggcttgtaatcgctgccatcctgatcatcggaatcgcggtgacgtttgcgaccagcagatttatccggcagaacggcggctctctggataccgtcgcggtgacgcagatgcccgggacgacagcgggcggcggcatgccgcaggcctatacggagggagcgggcacggagcttcccgccgcagccaggaagcgtatggaagaaacagtccccgccggggaagaaggagcagtatccgggaacacggatgaagcggccgccggggcggcggtaccggaacctgcttcctcccggatgatggcggcagagggagcggcggtgcctgctccggaatccattctgatggatgaggataaggaggccgcggatgaagcggtcccggaagcagcggcagcaggagcgggaaacaaggcggatgcggcggcagccccatccatatctccgttaggtccgggcggaagcgcagtgcttcagagcgacgaggaggaaaagctggcctactacgaaaagcgtctggcagagctggacgcccaggtacagaagatgcgcagcgaatcctctgattccactacgtattccatgaagacgctggccgagaaggagtttaagctctggaacatcgagatgaacaccatttacgcggaaatcatgaacggactggacgaggatgcgaagggaaagctggaaagtgagcagcagacctggatgaagagccgggatacaaaggcggaggaagcggcgagaaagtacagcggcggttctctggaaggcgtcgaatacacggcctcccaggccgagaccacgagaacaaggacgtacgatctcgtggaaacgtatattaactcgctgcctgcggagaatgaaggttagaagaaaaagaatccccatacagaacaggagtgccggttctgtatggggacttcgattttttggaaagataaccgccggcgatacaaaggaaaagggaggaaggatgacgtgggaaactggtttacgatcgattcgattggtgaagatacctttatgatcagtgagtacaggcactgggaggagacacacgcctacctgctgaacggcagtgaacggagtctgctcatcgacacaggtcttggaattgaaaatatttatgaggaagtgagctggctttccggaggatttcccctgccggttgagcaggtaagaaaatccgttgcagagcggtgtgatttgccggagggattctcggtcgaaacgtatgaaatctttcagggaaggccagcgagagtacttaaggatgatgaaattattgacatcggaggaagatcagtgaatgtgctgcacacaccgggccattcgccgggccatatgtgtttttttgagaaggagagaggctggctttttgcgggcgacctcgtatataagggcacgttgttcgcatactatccatcaaccgatcctcaggcgtatcgaacctccctggaacgcgtatcggcgcttccggtaacacgggtgtttccgggccaccacgatcccgatttgcggccggagtttctggaagaggtaaaaaatgcatttttgacgcttcatgcggaaggaaaactgcaccatggcggaggcatgcaccagtatgacggctttgccgtgtggatttaggaaatatcacagaaaatcggcggcaacatcttgataaataaaattcgatatgataggatagtacaatgagtttggctaatgtattaagaacggaggttgaatctatgacagcaattttagcaagttttctgcagacagcaatcaagtttctgtttttccttgcagtggcaggagggggaatcgtgtgcggcaagaagtacagagactacaaggatgcgaagaatgcaggcagtgtgacagaagaaagtaaataactaacggaggacagtaacgtgaacaagacaggtgtgaatgaactgaggagaatgttccttgaattttttgagagtaagggacatctggcgatgaaaagcttctccctggttccgcataatgataacagcttattgttaatcaactcaggtatggcgcctttaaagccatattttacaggacaggagataccgccgagaaagcgtgtgaccacctgccagaagtgtatcagaaccggagatatcgagaatgtgggaaagactgcccgtcacggcaccttctttgagatgctgggcaatttctcctttggagattattttaagacggaagcgatccgttggtcctgggagtttttgacagaggttgtaggactggatccggacaggttatatccatccgtctacttagacgacgacgaggctttcgatatctggaataatgaaatcggcattgccccggaacgtatcttccgcttcggcaaggaagacaacttctgggagcatggagcaggcccctgcggaccgtgttctgaaatctattatgaccgcggggagaagtacggctgcggaaagccgggctgcaccgtgggctgtgaatgtgaccgttacatggaagtatggaacaacgtatttacccagttcgagaatgacggacacggcaattacgaggaactggaccagaagaatatcgataccggcatgggtctcgagcgtctggccgtggtggttcaggatgtggattccatctttgatgtggacaccatcaaggctctgttaaacaaggttgcagagcttgcccacacggagtatcagaaggatgcatcggttgacgtttcccttcgtctgatcacagaccacgtccgttcctgcacctttatgatttccgacggcatcatgccatccaacgaaggacgcggatacgtgctgcgccgtctgcttcggagagcggcccgccacggaaggctgctcggcatcgagggaagattcctcgcggagctttccaagaccgtaatcgagctttccagagacggatatccggagctggaagagaagagagccatgatcttaaaggttctgactgaggaagaggataagtttaaccggactatcgaccagggacttgccattctcggcgagatggaagagaagatgtccgcctcaggcaagacggtgctggacggtgaggatgcatttaagctctatgatacttacggattcccgctggatttaacgagagaaattctggaagagaagcattttgagatcgatgaggatggctttaagaaggccatgcaggaacagcgtgagaaggccagagcggccagaaagaccacgaactacatgggcgctgatgtgacggtgtaccagtccatcgatcctgcgctcaccacggaatttgtcggatacgacaagcttgcctgcgattctaagattaccgctctgacgacagagacggatctggtggaagcactgacggatggcgagaccggcacgattgtgacggaagagactacgttctatggcaccatgggcggccagcagggcgataagggtgtaattgtcagcgtaaacggcgagtttgcggtggaagacaccattcatttacagggcggcaaagtcggccatgtgggcaggatgaagaagggcatgttccagatcggcgacgtagtcaccttaaaggtctgtgaagagagccgtatgagcaccggcaagaaccacagcgcgacccatctgcttcagaaggcgctccgcaccgttttgggcgagcacgtggaacaggcaggttcctatgtggatgaagaccgtcttcgtttcgacttcactcatttctccgccatgacaccggatgagattaaaaaggtggaatgccttgtcaatgagaagatcaaagaagcgctgcatgtaaagacagaggttatgagccttgatgaggcgaagaagtcaggcgccatggctctgtttggcgagaagtacggggataatgtccgcgtggtgaagatgggggatttctccacggagctgtgcggcggtacccatatttccaatacaggcgtgatcggctcctttaagatcttatctgagacgggaatcgcagccggcgtgcgcagaatcgaagccctgacgggcgacggcctgatgaagtattatcaggatgcggagaccgagcttcacgaggcggcgaaggcggcgaaggccacgcctcagacactgacagccaagattgaagccatgcttgaggagatcaaagcgctccattctgaaaatgagaagctaaagagcagactggccaaggactccctgggagatgttatggaccaggtgaaggagatcggcggtgtcaaggttctggctacgaaggttgccgatgtagacatgaacggcttaagaaacctgggagaccagctaaaggataagctgggtgaaggcgtgatcgtactggcttccgtcatggacggaaaagtgaacttaatggcaaccgctacggaggaagcgcagaagaagggtgcccatgcaggcaacttaatcaaggctgtcgcaggactcgttggcggcggcggcggtggaaggccaaatatggcccaggccggcggcaagaatccggccggagttgacgcatgcctggaagaggtttataaagtagtggaaggccagatgaaataagtaagaattttcccggaaaaaaatgaaattttccttgacgaatgggaaaattatgctataatcatatcagtgctataaaatacccaaacagttgtattatgcacaagtacacaactggagggaggttaggtgtgagctatgtcaaatgtaatcgttaaagacaacgagagcttagatagcgctttacgcagattcaaaagaaactgtgcgaaagcaggtatccagcaggaaattcgtaagagagagcattacgaaaagccaagcgtaagacgtaagaaaaagtctgaagctgcaagaaaacgtaaatataactaataattgattagtcaaacaaggttagtccctggtcattttatgatcagggatttctttgtttcatgtttactttcacgttaccctgcataatcggacgccgtttttgcatatagtataatatcattggctgaaaggcagaaacgatatgttcgaagagatgaagtttagtgcagctgagaacttaaagcttccgaaggatgtggtcctgggcgaagtgctggtatcttttctggggcgccacagtgttgtgattgaaaattaccgcggcatcattctctatacagataccctgatcaagctccaggcaaagacgtgccgcgtggcggtatcgggaagccgccttgtgattgaatattatacgaatgaggagatgaagattaacggactcatcaaatccatggagtttgaataaggatagaaaaacaaggaggtaccagcgtgattgtaacatggcttaaccaccggatgtccggttatctgtttgtggagatgacgggattttctccggaacggttctttaatatgtgcagcgttcatgagatagaaatctggggagtgtccgatacaggccattcctatcgcttttatatgaccgtgaaagggtttaggaagataaaacccattgtccggaaatcgaaggtcagacttaaggtactgggaaagtttggacttcctttttttttatacagaaacaggaagcgaaagctctacgcggccgggatggtgtccttttttgccctgctttacatactctccatctttatctgggatatcgagtttgacggaaatcacatgtatacgtatgacacccttttgaaatactgtgaaacagaggatatccgctatggcatgataaaatcgaagatcgactgcgacgccctggaagaatcgctgcggagcgcatttccggaaatcacctgggtgtcggccagggtatcgggaacacgtcttctggttaagataaaggagaacgaggttctctctgaaatacccgtaaaggatgagtcaccctgcgacatcgtggcgtcaaaggacggcgtgatcacctccatgatcgtgcgccagggcgttccggcggtttccgtgggtgatgaggtaaagaagggcgatgtgcttgtgagcggcacgctccacgtcatcggcgacggcgaggagatcatgaacacgcactatgtccattccgacgcggatatcacggcgcggacagaataccatattacgaggcagatgccgctgtttaagcgcgtggacgtggaaaccgggagaatacgccgcgggaagtatgcaaaggtatttcagtattccctgatgctgatacgcccgaagcaggagggaaccacctggaaggtgaccatggaagaggatcagcttcacctgtttcagaatttttatctgcccgtctatctcggcgatatcacggccaaagagtacatttcctacgagcgcccctacacggaggaggagaaaaatcaggcggctgaaaccatcaacgagaatttgaaaaaaaatttattggaaaaaggggtacaaattctggaaaatcatgttaaaatactagataatgaatctttatgccaaattgccatcgatattgtggcggaggaacccgtggtggaacggacgagcgtagagataccaattaatcaggaacaagaggagacgaaagagtccaatgagcgtaattgagacaatcatagatataccggctgaacacgagaagaatgtctgcggacagtttgacagctatttgaagaaaatagagaggactcttcatgttaccatgatcgaacgcgacggcgcgctgaagattatcggcccggaacagatggtgcagaaggcgaagagcgtctttaataatctgatcgagctgtcgaagcgtggaaatgcgatcacggagcagaatgtggattatgccctgtccctgtccttctcggagagcgacggacagattctggagattgacaaggacatcatctgcaggaccattacaggcaagccggtgaagccgaagaccatggggcagaagcagtatgtggaccagatccggaaaaagatgatcgtattcggaatcggcccggccggtaccggcaagacgtaccttgccatggccatggcgatccaggcctttaaaaacggtgaggtaagccggattatcctgacacgtccggccattgaggcgggagagaagctgggctttctgcccggcgatttacagagcaagatcgatccgtatttacggccgctctacgatgcgctgtatcagatcatgggcgctgagagctacttacacaatgcggagaaagggctgatcgaggtggcgcccctcgcttacatgcggggccgtacactcgacaacgcctatataatcctggatgaggcgcagaacaccacgccggcgcagatgaagatgttcctgacgagaatcggattcggttccaaggtcatcgtcaccggtgaccagacgcagaaggatctgccggccggagccgtatccggtctggataccgcggtccgcgtgctgaaacgcatcgatgacatcggcttctgttacttaaacagcagcgacgtggtgcgccatccgctggttcagaaaatagtacaggcttacgacgaatacgagacgaagaaaaaacctgcagagaaagaacgaaagacaacaaaagcccccggaggcagaaaggcacgttatgacgattcatattgagtatgagacggaagaggagttaaagcttccgtacgaggagatcatcaccgctgtggtgaacgaggcactggattatgagaactgcccttatgaggcggaggtgaatgtgctccttacggatgacgaggacatccgtcagatcaataaagaataccgggagatcgatcgtgcgaccgatgtgctgtcgtttccaatggccgactacgacagcccgtcggattttgaccgtctggaagacatggcaagcgattacttcaatccggagacaggggagctgctgctgggagacatcgtcatttccgtggacaaggtgaaagaacaggcggaaaaatacggccattccgagacgcgggagctggccttcttagtggcgcacagcatgctgcatctgtgcggctacgatcacatggtggatgaggaacgtctcgtcatggagaaaaagcaggaagagattctgaaacgagggggatacgaacgatgaagaaacgggcatggttctgtgcggccggactgctccttttgatgggagcggtgaccggatgccagggaaaatatcaggaggtggctgtgacggacgcctcggcagagacggacaccacgcccgcccctacgaaagagattaagattgagactaccacggaggcacctgcggaggaggctgtggaatccggcgactggtataccttcgaggagcgcaccgagcaggatggaaagatccgcagctacttaaccggcgagatggtcgatgcggcaatcggaaaccgcagacccatcgccatcatgatgagcaacgacaaggcgtcgctgccgcagtacggcatcaaccgggcggatatcgtgtatgaggcccctgtggagggcggcatgaaccgttacatggccattatcgagaattacgacgatctggacagaatcggttccgtgagaagctgccggacgtattatacatactttgcccgcgagtttgacgccatttacgctcactacgggcagagcacctttgccaagccgtatctggccaatgtggacaacatcaacgggctggatggaatcggcaccgtggcgtattacaggacgaaggaccgtaaatcacctcacaacgcgtattccagcggagaacggctgaacaaggcgatcgcccagctgggatactcagagagctacagcgcggattaccagggccattaccgctttgcgaaaacgggccatgaggtgacgctggacggagcgcccagtgtgatggaagcagccagggtctatccgggctacgtgatgaataagccgtggtttgaatataacgagagcgacggcttatactaccggtatcagtacggagcggcccataagggcaatgaaggcccgatcgccgtgaagaatattcttttccagtactgcccgtcagggcactacgccaccacggattatctggatatcaacgtccacgacgactcctacgggctctatgccacggaggggaaggcgattccggtgaagtggacgaaggacggggagttcggcctgacacattattacgacatggagaataacgaggtgattctgaatcagggaaagacgtggatatgcgttatttccgcacaggattcctcaaatgtagaggtttatggaaaataacaggacaagcagaagcagaaaaaagcctgagaaaaagggcgcgtcaaattttatcatacagggaacgattcttgcggcggcgggaatcattgtgcgtctgatcgggatgctgtaccggattccccttgccaacattctgggggatgagggaaacggatactacagttcggcttttaccatctattctatcttgctgatcgtctcctcctacagccttccaacggctgtttcgaagatgatcgcgacgaagaatgccaggaaagagtataagaattcggtccgtattttaaaggcagctctgttttatggcacggtagtcggagggatcggagccgcggttttgtggttcggcgctgatttcttcgccacccgtttcttaaacatgccgtataccagatacgcgctcaagacgctggctcctaccatatgggtcatcgcgtatctcggcgtgttccgcggatattttcagggcttggggacgatgattcccacggccctttcgcagatttttgagcagataatcaatgccgttatcagtattgtggcggcggaacggctgttcaatgcaggattaaaggcaaacctggtgcatgaaaccacggaattttcctttgccttcggagctgccggcggcaccatcggtacaggcgcgggcgcggtggcagggcttctgttcctgctttttctgatggccagttaccggcctgtcatgatgaggcaggcaaagcgtgaccggaccagacggagagacagctacggcgagatctcttccgttctgctgatgaccgttcttcccattgtgatgagcagcgtggcttacaacattagtacggtcatcgataacagcatctatgggaaaggaatggcgtttctcggaatgggagcgtcggaggccgtctcaacctggggcgtctatgccggaaagtaccacctgctgtttaatattccggtggccatagccaattcgctggcctcctccctgattccgtccctgtcgcgggcggtggcaggcaaaaaccgcggacagatcgtgagcaaggtatccatggtcattcgcttttccatggtgatcgcgattccggccacggtaggacttaccgtgctcgcaggccccgtgtgcaatctgctgttcagccgttacgataacaccaacctgatccgcatgatgatgtacggttcgctggctgtcgtattcttctccctgtctacggttaccaacgccgttctgcagggaatcaaccatatgcagacaccgcttaagaacgcagtgatctcgcttgtgctccatatccttgtgctctgcgtcatgctgttcggatttaagatggggatctacagtgtggtatattccaacattctgtttgcgctcttcatgtgcatcctgaatggaatttccatcagacggttcttaaattacaggcaggagatgaagaagacgttcattcttccgaccatcgcctccggtatcatgggcggggcggcttacggcgtttacaagctggttcatatgacggtcaagagcaacaccatcggcgtgcttctggcgattgtggtggcggttatggtctacggcgtcctgcttttgaagctgcgctgcgtggacgagacagagcttgccggtatgcccggcggtacgaaactggtaagaatcgcacagaaatgccatttgatgtgattaaaatgagagaagaaagcagatactatacttcgaaggaggtattatcctatgaagaagtatatgttctgctttcttttatttgcagccacttcgcttctctgcctcggaattggttttgttattaccaaggacagcgtgcagccggaggaggccatacccggagcgactctggagacggagaccgtgacggaggaccagatcgtcatcaatcaggagaaggtgtcgcctgcgccggagaaggaaaaggagaaattttatctcgtatcggaagacggttatctgcttgtcctgtatcaggataagacgacgatctgcctgtatacccatatgccggtcaccgatttcccggaggaggagcggggccgtcttatggatggcatctggttctcctccatgattgaggtgtttaactatctggagtcgtatacgagctagagtgtgtctgaccgaatggaccaaaacacaggactcgtcaggaaaaataatgcttgaattgaatggaggaaccggatacaatagggctggtgacagtacggtcgccaagtgcttacagcaaggaggaatccatgaagagaagagtgatgatcataggcggaggcgcctccggtatgacggctgcgattgcggctgccagggagggagccgatgccgtgattctggaacatacaaagagacccgggaagaagatcctgtctaccgggaatgggaaatgcaatttaacaaacctggatatgagaaaggaagccttccgcggggagaatcccggattcgcatggaaggtggtcggggaggtgccggtaaaagagacactttccttttttgaggatctgggtctggtgctgacagaccggaacggatacgtttaccccgccacggggcaggcgtcttctgtgctggatgcgctgcgcttcgagctggaacgcttaaagattccggttctctgtgaatgtgaggtcttaagcgtgtcaaagaagctggaactcgccacatcccagggagccatgaaggcggatgcggtcatactcgcggcagggtccaaagcggcgcccggaacaggatcggatggcagcggctataagctggcggagagtctgggacacagcgtgatagaaccgcttccagccctggtgcagttaaaatgcagggagacgtggtataaacagtttgcaggcgtaaggacagaggcttctgtgacactgtattccgatggaaaagcggtcgcttccgaccggggagaactgcagtttacggattatggaatctccggaattcctgtttttcagatcagtcggtttgcggcgcgcgccttaagggatgggaagaaggtgactgcccggctggatcttctgccggttatggaaaagcaggagctctttcaattcttaacgaaacgggtaaaacggctgggataccggccgggggaagaatttttaaacggcgtcctgaataagaagctgcatcaggtgcttcttaaggaatccgggataccggctggccgccggacccgggagatcatggaaaaacagctgggggttctgacagaccggatcaaagggctcgaaaccaccgtgacagcggtgaatccctttgagcaggcgcagatctgctgcggcggtgtcgatacgagagaggtaaatccgtgtactatggaatcaaaattagtcagtcagctgtttctggcgggagaaattctggatgtggacggcatctgcggaggttataacctgcagtgggcgtggtcatcgggaattctggcgggcagaaacgcaggaagaggtcctatatgataagaatcagccagttaaagctgtctgtaaaccacagcgaggaagatttaaagaagaaggcggcaaagacgctgaagcttcagccggcggacattcgccgcgtaacggttgtgaagcagtccgtggatgcgagaaaaaagagcagtgaagtgctgtttatctatacggtcgacgtcgaggtggcgaaggaggacaaggtattacatagagtgaacagtccgaacattgcgaaggccgagaagaaggaatatcaatttccggaaccgggaacggagcgtttagagcaccgccccgtcatcataggaagcggaccggccggccttttctgtgcactgatgctggcaagagccggctttggccccatcgtattcgagcggggagagcgggtggaagagagaaaacggtcggtgcttcagttctggcagggcggagagctgaagagcaactccaacgtacagtttggagaaggcggtgcgggaacattttccgatgggaaactcaacacgctggtaaaagacccgctgatgcggaaccgaaaagtgctggaggtgttcgtggagttcggagcggatccatccattctttataagaataagccccatatcggaaccgatgtgctcagtgtcatcgtgaaaaatatgagggaagagatcatccgtctgggaggaaccttttacttccagagctgcgtcaccgattttcggattaaggacggagcgctgaaggctatcacggtaaacggatcggaagaatttgagacggatgtcaccgttctggccgtgggacacagcgcgcgtgatacctttgagcggctgctggagagaagcgtgcccatagagaagaaagcgttcgccgtcggactgcgcattcagcatccgcagagagacatcaatgccgcacagtacggcgctgcagagatcgaagcgctgggggcggccgattataaggtgacccatcagtgtgccaatggaaggggcgtatactccttctgcatgtgcccgggcggctacgtcgtcgatgcgtcctctgaaccggggcgtctggctgtcaatggcatgagctatcatgcgagggacggcgtgaatgcgaacagcgcactgatcgtcaccgtcacgccgcaggatttcccggaagacagccctcttgcgggcatcgcctaccagcggcgtctggaggaagcggcctaccagtgcggcggagggaaaattccggtgcagctgtaccgtgattttaagaagaaaagggcgacaacggcctttggagatgtggcgccggcctttgaagggcggtacgccatggcaaatctgcgggatttctttccggatacgctgtcggaatcgctgatcgagggcgtagaggcgtttaacgggcggatcgcaggattttccagaggcgacgccatcctggcaggcgtggagagcagaacctcgtccccggtgcgcataccgagagatgaacggtttgagagcagcatcaaaggtatctatccctgtggggaaggcgccggctacgcgggcggtatcacgtccgcggccatggatgggatcaagacggcggaggcagtcgcggcacgcttctcagtcccaacgtaacagtttaaccctcgcttccggccgctgctcatttgacgaatggataaaaatgttgtaagatatgagacaaaaagactgaaagaacatgattggagacaccatgagaactgaagtgcgggaaaagctgaaggataaacagaggattgtcataaaaatcggttcgtcttccctgacccatacgtatacgggggacttgaacctgatgaagatcgagaagctggtgcgtgtcatcagcgatttgaagggagaagggaaatccgtggttctggtttcgtccggggccatcgcggtgggacgccaggcgcttggccaccacacgaggccggttaccatctcggagaaacaggcgtttgcagcggtaggccaggcgcggctgatgatggtgtatcagaaactgtttgcagagtataatcaggtggcggcgcaggttctgctgacgaaggataccatgatcaatgaaagctcccgctataacgcgcagaataccttcgacgagctgctgaagctgggcgccataccgattgtgaatgagaacgatacggtatccacctcagagatcccttacgtcgataatttcggtgacaacgaccggctgtccgccattgtagcggctctgatcggagccgacttactgattcttttgtcggatatcgacggcctgtactctgacgatccgagacagaatccaaaggcgcgttttatcagccaggtggatgagattacgccggagctgatggagatgggaaaggccacctcgggcagcgacgtgggcaccggaggcatggcggcgaagctggcggcggccaggatcgccacagacagtggttccgatatggtcattgccaacggggatgacgtggaggtcgtctcacagatcatgatgggtgacagtaaggggacgcttttcctggcccatcccaactttgatttcgatctgatgcactacataaataatgaatattaggaggcacatcgatgcagcaggaaaaaatagacagaatcaatacgctctaccacaaggcgcaggcggtaggactttctgatgaggaaaaggccgagcaggccgccctgagaaaggaatacattgaagcgatccgcatgagcttaagaggaaacttaaacagcatttcggttaaggaagaggacggaaccattacggatctggggaaaaagtatggaaatgtcaagcaagaatgaaatcagggaatgggtgaaggagaaccggcaggctctcacacagaaacaggagatggagtggaatgacgccatctgcaggaagattttaagcctccggtccatccggcaggcgttctgtgtctactgctacgtatccttccgtcatgaagcagggactgagaagctgattcagggcctgctggagatgggaaaatacgtggcagtaccgaaggtagaaggaaaaaaactggtattctatgcaattcagggaaaaaaggatttagagagcggcgtcatggggatcatggaacccaaatccagctgtctgcgcatccgcgacgaattcgcaccagtcatcgtgccgggaatcgcatttgacagggaaggacaccggatcggctacggcggcggctattacgaccgcttcttcgacgaagagccggaacatcccagattcggaatcgcctatcccttccagcttttcgattctctgccggcagaggcccatgacaagggaatggatatggtaatcactccataattcaaactcaaaatgtggagtgaaatagcaggataacagggaggaacgcgatatgacactaactgagacaggaaaaagagcgaaagagacggccggtgttctggggattctcggctctgataagaagaatgaaggtttaagggccgcggccgccgctttgcttgagggcgaggaagatattttgacggccaatcaggacgatgtgattcaggcgacgataaatggcatgagcgccgggatgatcgaccgcctggagctgacaccttccaggatcgaggccatggccgacggactgatcagcgtggccgggttagacgacccggtgggagaggtgatctccatgaaggcccggccaaacggactcaccatcggacagaaacgcgttcccatgggcgtgatcggcatcatctatgaggccagacccaatgtgaccgcggacgccttcggactctgcttcaaatccggcaactgcgtgatcttgaaaggcggaagcgacgccttagagtccaacaaggccatcgtcaaatgcctccgtgcaggacttaagaacgcgggacttccggaggacagtgtacagcttatcaccgataccgacagggaggtgacgaaggaattcatgcgcctgcacgactacgtggatgtgctgattccgcgcggcggagccggactgatccgttccgtggtggagaacagtacggtgcctgtcattgagacgggaaccgggaactgccatatcttcgtggatgagactgcggatttcacgatggctctggacatcatattcaatgccaagacccagcggatcggcgtctgcaacgcctgtgaatcgctggttatacatagaaaaatcgcggaagagttcctgccgctgttaaaggccaggctcgacgaaaagcaggttgaggtgcgggcggatgaagaagcctgccgtatcgtgcctgcgtttgtcccggctgctgcggaggattggggaacggagtatttagactatattctgtccctgaagctggtggattccatagacgaggccatcgcccatattaaccgctataatacgaagcactccgaggccatcatcacatcggattacgcaaacgctcagaagttcttaaatgagatcgatgccgccgccgtctacgtcaacgcgtccaccagattcacggatggattcgagttcggttttggcgcagagatcggcatcagcacccaaaagcttcacgcgagaggccctatggggctaaaggagcttaccacgacaaagtacattatctatggaaacggacagtgcaggccgccggctttgtaaaatagctgtttccatatcaaagtccgccttgccacagggcggacttgattcttttgttacaattcgcggcccccacgcaccggaacgcccggcggagtttttccgtggggccgctaattgtaactttttttcaggtggacggccgttgtatttttggtgtttgcaatagaatgtatttatgctataatattcaaagtcattccgggtttacagattatgacggaatgcggagtgagataaatggaggaaacagctggatggatcatttacatatgacacatgaggaagctttaaaggccgcgccggcggaggaaccgggcagacagcagttctttatggaacgctgccgccagttaatcgatgagaagaagaggcggggcgaaacgtaccgcggaacctttcacatcgagacgttcgggtgccagatgaacgccagagattcggagaaactgaccggaattttagaggcttccggatttacggagacggacacggaggaggcggatttcgtcctctataatacctgtacggtcagggacaacgccaatcagcgcgtttacggcagactcggctacttaaaccgcatcaaacagaagaatcccaatatgatgatcgctctctgcggatgtatgatgcaggaggaaaccgtggtgaccaagattaagaagagctaccgctttgtcgacattatattcggaacccataatattttcaaactggcagaactgatttctgaacgcatggatgagaagaagatggtagttgacatctggaaggggactgaccggatcgtggaagaacttcccaccgaccggaagtacccgttcaagtccggcgttaatattatgtttggttgcaataatttctgcagctactgtatcgttccttacgtgcgcggccgcgagagaagccggaatccacaggatatcgtgggagagatcagacgcctcgtcgcagacggtgtggtggaggtcatgctcctgggacagaatgtcaactcctatggaaagaatctggaagaaccgatgacctttgcacagctgttaaaagaggtggaggccatcgatggtcttcggcggatccgttttatgacctcccatccgaaggacttatcggatgacttaatcgaggtcatgaagaattccgggaagatctgccatcatctccatctgccgctccagtccggaagcagcagggtcttaaaggccatgaaccggagatacacgaaggaacagtatctggaactggtggagaagatcagggccgcggttcccgatatctctctgaccacggatatcatagtcggcttcccgggagagacggaggaggacttcctggagaccatggatgtagtgagaaaggtccgttttgacagcgcatttacgttcatttattcgaagcgcacgggcactccggcggcggccatggaagagcagattccggaggctgtggtgaaggaccggtttgaccgcctgctctcagaggtgcagaggatatcggccgaggtatgcggacgtgacgcccacaccgttaaggatgtactggtggaggacttggatgaccatgtggaaggctttgtaacgggccggctcgataacaacaccaccgttcatttcaagggagatgcgtccctgatcggtcagatcgtggatgtgtatctggatgagtcgaaaggcttttattatatgggaacattaaaatagtacgacagaagaaaagaggaaaaaacgtggccggaatgtcaccaatgatggtccattatttggaaaccaagaaacagtacccggactgtatcctgttttacaggctgggagatttttatgagatgttttttgaagacgcgctgaccgtctccaaggaactggagattaccctgacaggaaaagaatgcgggctggaggaacgggcgccaatgtgcggcattccttaccatgcgcttgaaaattatctgtacaggctggtccagaagggctataaagtagcgatcgcagagcagatggaggacccgaagctggccaaggggctggttaagagagaggtcatccgtgtcgttacccccggaaccattaccagcgcccaggcgctggatgagacgaagaacaactacctgatgggcatcgtctatatcgacgagcggttcggcattgccgtttccgatatcagcacaggcgattttttggtgaccgaggtggagacggagcgggagctggcggatgagatcaacaagttcagcccctccgagattatctgcaacgatgcgttctttgtgtccggcgtggacacggaggaggtcaagaaccgctaccagaccgtgatcgccgcacttgacaaccatttcttttccgacgagggctgcaggagaattttaaaagaacactttaaagtgggatctctggacggtctgggcctgcaggattacgatacgggagtgatcgcggcgggggctgtcatggagtacatgtacgagacccagaagagcacactgtcccatattacgaccatcgttccctattccacagggcagttcatgatcatcgacacctcgacaagaaggaatctggagctcctggagaccatgcgggagaagcagaagaggggaacccttctgtgggtgctggataagacgaagacggccatgggcgccaggcttttgagaacctatatcgaacagccgctgatccacaaggatgatatcattgcccgccagaatgccatcgaagaactgaacatgaattacatttccagggaggaaatctgtgaatacttgaatcccatctacgatctggaacgtctcatcggccgcatcagctataagacggcgaatcccagggatttaatctccttcaggaattctctggaaatgcttccttacataaaagatctcatgggagaattcacgactcctctgctgaaagagctctgggaagagctggatgccttagaggatgtccacgatcttgtctcccgcgccatcgtggaggacccgcccatatccctgcgtgacggcggcatcataaaggacggctatcacgaggagacggataagctgcgccacgcgaagacggaaggaaagacgtggctcgccgaactggaatcgagagagcgcgacaagaccggaatcaagaacctgaaagtcaagtacaacaaggtatttggatattacttcgaagtgacaaactcctttaaagggatggttcccgattactttgtccgcaagcagacgctggccaacgccgagcggtacacaacggatgaactgaaggagctggaggacatgatcctgggcgcggaggacaagctctataccctggaatacggtctgttctgcgaggtgagagacgccatcgccgccgaggtcctgcggatccagcagacggcccgggcgatcgcgggcatcgacgtgatgacttccctttccgttgtggccacgaagaataattacgtgaagccgcgcatcaatgaaaaaggtgtgatcgacatcaaaaacggccgccatccggtggtggaaaagatgatgcgggacgatttattcgtcgccaacgatacgtatctggacaattcgaagaacaggctctccatcatcaccggccccaacatggccggtaaatcgacgtatatgcgccagacggccttaatcgtattgatggctcagctgggaagctttgtgcccgcggatgacgccaatatcggcatttgcgacagaatctttacccgtgtgggcgcttccgatgatctggcatccggccagagtaccttcatggtagagatgaccgaggtcgccaacatcctgagaaacgctacgaaaaacagcctgatcgttctcgacgagatcggccggggcaccagcaccttcgacggcttatccatcgcctgggcggtggtggagcacatcagcaacccgaagcttttaggagccaagacactgtttgccacccattaccatgagctgacagagctggaaggaaccataaacggcgtcaacaactactgcatcgccgtaaaggaacagggcgatgatatcgtatttcttcgaaagattgtgaagggcggagcggataagagctacggcgttcaggtcgccaagcttgccggtgttcccgattccgtgattgtacgggcaaaggagcttctggtggagttaagcgacgcggatatcacggcgagggcaaaggagatcgcggaagcgggcgcaggtgcgccgaagcatgccagcatccccaggccggatgaggtggatttgcagcagatgtccctgtttgacacggtgaaggacgacgacatcgtccgggagctgggagaactggagctgggaaatatgacgccgatcgacgccttgaacacgctgtaccgccttcagacgaaacttaagaaccgctggcagtaaagagataaaggagcgatagccatatgccaaacattacgctactggatcaaaataccataaataagattgcagcgggcgaggtgatcgagaggccggcctctgttgtgaaggagcttttagagaacgccatcgacgccagggctacggctgtgacggttgaaataaaggaggggggcaccaccttcatccgcgtgaccgacaacggctgtggaattccgagggaagaggttcctctggcgtttctgcgccactccaccagcaagatcaagtccgtggaagatctctttacgatctcatctctgggctttcgcggtgaggccctcgcaagtatcgcttccgtctgccaggtggagctgatcacgaagaccagcgaagccctgacgggaagccgctacagcatcgaaggcggcattgaacggccgctggaggagatcggcgccccggagggcaccacatttatcgccagaaacttattctttaacacgccggccagaaggaaatttttaaagactcccatgacagagggctcccatgtggccgagctggtggaaaagatcgcgctctcccatccggagatttcgatccgttttatccagaataaccagaacaagctgcatacctccggcaaccacaacttaaaggacatcatctatacggtcttcggcagggagatcgcggcgaatctgctggcagttgaggcgaagaagcaggatatcgccatcagcggctttatcgggaagcctgtgatcgccaggggcaacagaaactacgaaaattatttcatcaatgggcggtatatcagaagcagcatcatatcgaaggccatagaagaggcctacaagccgtttatgatgcagcacaagtatccgtttaccatgctccatttcaccattgagccggagcttctggatgtcaatgtccatcccaccaagatggagcttcgcttccgcgacggggagatggtgtaccgtatggtctacgacgccgtatcgggggcgctcgctcacaaggagctgattccggaggtggaactgaataaggaaaaggcggagcaggaggcaaaagaggcgaggaagcacgagccgtcaccggagccctttgagcttcgcaggctggaggccatgagccggcagcaggccgcctgcgcgcctggctccaaacggcttaagccggcagaaccgtctctcatgagagatcctgattttctggctgaaaactggctgaagaagccggcaggcgcggactttttacacgggttaccggaatcggctgcgaaaaatgaagaaacggtacaaaatcaggcagatggtgcaagggaacatggacaattaaacggaatgacggaccgtggagtgcagcccggagagggagaggcagcagcggaagaggcagcagcgagagatgcggcagcggaagaggcagcagcgagagatgcagcagtggaagatgcagcagcgagagatgcagcagtggaagatgcagcagcgagagatgcagcagtggaagatgcagcagcaagagaggctgcagcgggtgaagcacaggcaggtgcagccgcattttccgggaagccggaacagctggatctctttgacggaaagctgctggaaccgaaatcaaggctgatgcataagctgatcggccaggtgttcgacacctactggctggtggagtttaacgaacagctttacattattgaccagcatgcggcccatgaaaaggttttatatgagaaaactatggcaacacttaaaaacagggaatactcatcgcagatgcttaatccgccgatcattctgaccctgaacatgaacgaggaggtgctgttaaaagagcacatgaagtatttctcggacatgggcttcgagatcgaaccgtttggcggcagggagtatgcggtgagaggcgtaccggccaacttgctgtctatcgccaagaaggatttgctgatcgagatgatcgacgggctttccgacgatgtttcgactcataatccggatatcatctatgagcgggtagcgaccatgtcctgcaaggctgcggtcaaaggcggtagccggctgtcgacggaagaggccaacgaactgatagaccagctcctgaatctggagaatccgtatgcgtgtccccatggacggccgacgatcatctccatgagcaggtacgagctggagaaaaaattcaagaggatagtgtgaaagaaagtagaggacagccaaaaagtggcgcactaatctaagctgtcaagaaatggcaactttttgaagtgttgattttcgaaaataattttaagaagctattggttccggtggtggatataatccttcacgttgtaatagcttcatagcctgcttgatagctttcgttttttgtttttcaagtaaagcttcaggcatatctattttgtataagtcgcttggattccatgcttcaccagttgataacatctggtagattgcagtaagaatcattcgagcgatagcaactatggctcttttcttgccacggcgtttcataagagattcatatttctttttgtagtaaggagacttttcggatttaacggctgcatgagcacattgtactaatgcaggtttgaggtaaactccagcacgtgcgatccgaacagatttcttcttgccaccagattcattgctgccagggactaaaccagcccaacagcataaacgtttagaagaacagaattgagacatatcaatacctgtttcggagatgatagtgattgcactatcacgtttaacacccggaatagtcattaggaactggatagcattttcataatcaggatcagaagaaatcatagattctatcatagagtctacatcattgatttcagctgtgatataatccatatgtgcacggacgaggcgcatacgatatttctgggaatcagtcatctgatatccttcaatggattccatcacagcatcttctttggatttgagacgtctaagaagcttagaagcgatttcttcatggttgatagaattgtcagcctgctcaagcaggtaatcaataatggatgtggatgacttcccaaagatatcggaaacaacagaatctaaagcgacattacaaacagtaagcgcattctgatatcgattcttttcactggaacggcaggaaaccaatttgtagcgataccttgtatattctcgtaaaatacggattttcttacaaggaatgtagctgcctttcacaagtccgagacggaacaagtccccaatccatttagaatctttggtgtcatctttgttacccttcacagcttttacccattttggattagcaatggtaacattgatttcatcttctaaaagattaaaggcaggaacccagtatttaccagtggattccatgcagacatcatggcattcattttcaagaagccattgcttgaactcaagaattgagtggttgaaggtggaaaaacgtttcttttgataagaaggttcgataccaccattagtcttgacgattgtggcaacgagaaatgatttgtgaacatcgacaccacaacaggttaggtaagtaactttcatagtcatactcctttcgtgaaaaagataagaagccattgactgaactgccacacaatttaaccaaggcgttaaaacaattcttagtgtacgggctcatggcaccacttatttgtgcttgaaaaggcaggacttacactgattagtatgctgtctaaaacgagaaagaatttacaactcctcctcccgtgctttgtagtgtagcttcttgaagctattatctcatggagtagagggcttgaaaatctttcattactatttgtgccgcgcccgaaggcgcgcggaatggagattagtatgatgaaaccactgattatcttgacgggtcccacggctgtgggaaagacggccctgtctgttcggctggcgaaggccgtgggcggagagatcataagcgccgattccatgcaggtttaccgccacatggatatcggttctgccaaggtgacccgggaggagatggatggggtacctcattatctcattgatattatggagcctgccggggagtttaacgtcgccgcgtttaaaaaactggcggcggaggcggtagaggagatatacgctcacggacatctccccatcgttgtcgggggaaccggtttttacattcaggccctactgtatgacatcgattttacagagcagggagaggaacgggagatcagggaggagctggaacggctgggagaggaacgcggcgccgtttttctgcatgatatgctggcggagatcgatccggaggctgccatggaaatccatgccaacaaccggaaacgcgtgatccgcgccatcgagttttaccggcagacgggagaaagaatctccgagcacaacaaacgggagcggcagaagcgctctccctatgacttcctgtattacgtccttacggatgacagaaagacgctctatgagcggatcgaccagcgggtagacgccatggtagaggccggtctggtcggtgaagtggaaaaattaatggaaatgggctgcacgaaggacatggtctccatgcagggactgggatacaaggaaatcctggattaccttcaggggaacacctcccttgacgaggcggttaccattttaaagagagatacgagacatttcgcgaagcgccagatcacctggtttaagcgggagcgggatgttcgatggctgaatctggaagaattcggccgcgacagagaaaaggtcctggagaaaatgcttcaggatatcagagaaacgtatggattggagacagaaaatcatggaaatggatgcgatgtatgagcagctgggaatcgaaagaaaggttctggagttcggaaaggagatagaagggctgctttctgagcgcttcgcggcgatcgatgagacggcggagtataatcagctgaaggtgataaaagccatgcaggacaaccgcgtcagcgacattcattttgccgcaaccaccggatacggttacaacgacctgggacgggatacactggaagatgtatacgccagcgtgttccacacggaaagtgccctggtgaggccgaacttaatcagcggaacccacgcgcttcacgtggcgctgtcgggcaatctgcggccgggagacgagcttctttcaccggtggggaaaccgtatgacacactggaggaggtaatcggaatccgggagagcgcaggctctttaaaagagtacggggtcatctaccgccaggtggatctgcttccggatggaagctttgattttgatggaattgcagcggcagtcaatgagaagacgaaactggtgacaatccagcgttccaaggggtacgccacccggccgaccctgtcggtagagcggatcggtcagctgatcgcctttatcaaggaacggaagccggatgtcatctgtatggtggataactgctacggcgagtttgtggagaggctggaaccggccgacgtgggagcagatatgatggtggggtctctcatcaagaatccgggcggcggactggcgccgatcggcggatacatcgccggaagaaaggactgcatcgaccgcgcatcctaccgcctgaccgcccctggtctgggacgtgaggtaggagccagcctggggcttaaccagtccttctatcagggactgttcctcgcgccaacggtggtggcaggggccttgaagggagccgtatttgcagccaatgtctatgaaaagctgggattttccgtggttccgaacagcacggagtcgcgccacgatatcattcaggcggtgaccttcggaaagccggagggggttatcgcgttctgccagggaattcaggcggccgcgccggtggacagttttgtcactccggagccgtgggcgatgccgggctacgacgcgccggttatcatggccgcaggagccttcgtacagggcgcatccatcgagctttccgccgacggaccgatcaaacctccgtacgccgtttatttccagggagggcttacctggtaccatgcgaagcttggaattctcatgtccatgcagaaattaaaggacgcgggactgatcacgttatagagccaaacggcaaaaaaagtgtatacacgactgcgtttctatgatagaataacaaagcaggcatggattttcctgccaaaaacgaatgaggggtagtaacagatgaaacgtaaaaactgctgggtactgcttcttctggtgctgacggggattgtgctgggcggatttatcgggacgatggctcaggatgtatcctggctgtcctggctgaatttcggacagtccttcggattcgattcaccgctcattattaacttcggtattctggtcattacctttggcctgagtatcaagatcaccatggcaagcatcatcggagtggcattggctctcattacctatcggttcatttaaatacatatgtctttgacacgtacctggagagtaacggacaggagacatatgaacagaattacgatgaaagacataccggcggatgaccggccttatgagaagtgccttcggacaggccctgaggggttaagcgacggagaacttctctccattatcatccggacgggatccagggaagacagttccctggcacttgcacaaaagatactggccttaaattaccccagcgagggtattttagggcttttgcatctttcactccccgaactgactcagattaagggaatcggaagagtgaagggggcgcagcttctctgtatcggagagctgtcgaagcggatctggaagaaggctgtgctggaagacgtggccaccttttccaacccggaagacatcgtgaactactatgtggaagacatgcggcacatggagcaggagcagatccgcatcatgctgctgaacacaaagggcgtgctcataagagatgtgctgatttcccaggggacggtgaacgcttccgtcgtttcacccagggagatttttattgaggcgctgaagtaccacgccgtgaatgtcattgtggttcacaaccatcccagcggcgatccggcacccagccgggaagatatcacattaaccagaagaatcatggaagccggagaattgatcggaatccgtatgttggatcatattatcataggagacaattcctataccagttttaaagaacggggaatcatatagatggaatcgaaacgcagtaaatacgtcctgattgccttaacggtgatctgtgtgcttttaatcggccttacatcaatccatgacgagtggctgacgcctttgaggaccggagtcgggtactttctgatcccggtgcagtcaggagtcaataaggtgggctccgccatttacgatgaaatcgtggattatacaaaactgaaagacgctctggaagataacaaggagatgaaggacatcatcacccagctgacggaggaaaataccaggcttcaggcggaggaattcgaactgaagcggctgagacagctgtatgagctggaccaggaatacggccagtacaataaggtcggggccagagtcatcgccaacgactccagcaactggttccaggtgttccggatcgacaagggatcaaaggacggaatcgccgtggatatgaacgtggttgcaggcggaggtctggtgggaatcgtcacggacgttggcgccaattacgccacggtccggtccatcatcgatgattccagccgtgtcagcgccatggccatccagtccggagacggctgtatcgtgggcggtgacttaacactgtttaaagaggggcggctccgcatcaccaacgtgctgaaggacagcgacttaaaggatggcgacaagatcgtcacctccaacaccagctccgtctttgtgccgggaatcctggtgggctatgccgcggagattaccaatgacacaaacaatgtgaccaaatcgggttacttaattcctgcagctgaatttgacagcctgcaggaggttcttgtcatcaccgatctcaaagtgaagatgacagaggagacaaacgcggaagacggcgcctctgccgagacgcaggcgggagagagtgagacgaacgaggccggggagacggcggcttcttcggaagaagagactgctgcggcacagtagaagccatgaagaatcgaaaaaacgataacgaaaggagcggcggcgatgaaacgaatcatctttaatattcttatgattattctggcgtttacggttcagaactgtatcttcccgctgctcccgtttctctctgcatctccgaatctgctgctgattctgaccttttccttcggatttatccacggaaaggaggccggtatgtactacggccttctttccggtcttctgatggatttattctacagcggcccgttcggtttttacacgcttattttcatctacgtgggatatgtaaacggcatctgcaccaaatactactatgaggattacattacgctgccgcttattttaagcgtgctcaatgacctggcgtacaatctttatatttatgtgttccggttcctgatccggaaacgtctcggaatcggatactacttcatgaacttaatgctgccggagatcattttcacggtggtgacaacactgcttatttaccgtattttcctgatgttcaaccgtcatctggaagagatagaaaaaagaggagattcatcgattgtttagagatttattagacatcttaaaagactttttgaagaaaatcgcatcgtcaagactccttgtactgggagtcatctgtatagccatgtacgcaggactcgtccataagctgtttaatttacagatcgtaaacggagaacaggcgttaaacgattacatgcagctgacggagcagacccttaccacagcgggaacacgcggcaacatctatgacaggaacggcaaggtgctggcttacaacaagctggcttattccgtgaccgttcaggacaccggggaatataagaccacggcagatcagaacgccatgtatctaaggctggtccgaatcctggagaagcatggggagacggtacagggaaagtttgaggtagccatcgacagcaacggagatatgatctatacttcttcctcagaggccggcaggaaacgcttcctgcgggattattatggcttgaagagtgtggatgagctggatgatgaagagaataagtacccttccgcgatcacggcgagagaattgtttgaaaaggcgtgtgccaccggcaaattaactgagatgaaggattccgacggcaatccggtcaccatgacggatcaggaggcgctggatatcatcaatatcaaatacgcactccgtctcatgtcgttccgtaaatacgaggcgacgacggtagcgacacaggtatcggatgagactgtcgcggatgtactggagcataccgcagatctggcaggcgtcaacgtggaggaaaccaccatccgggcctacaacgacagtatcgcatttgccccgattatcggctataccggcaaggtgcaggaagaccagctggaggaactgaaaaagaaccgtcccgactacgatgtgaatgacatcgtgggaactacgggaatcgagtatacgatggagcaggagctccaggggacgaagggcagcaagaccatctataaggacagccggggccgggtcagagagacgctcgacgagaccgagtcgagagccggcaacgacatttaccttacgcagatcgcagggctgcagaccggtatttaccatctggtcgaacagtccttggccggtgttctgttaaagaaaattgagccaggcgacgtggagattaccagcagcacagatggatcgaacatgacgatccctgttaaggatgcgtatttccagctgattaacaataatattctttctctgaagcatctcgaatccgaggaggcctcagatgtggaaaagaatattaacagcaaattcttatcatcgagggaacagattttttcagaactgcagaatgaacttatgagcagccatccggcttcattgaaggatctggatcaggatcttgctgcctatatgtactatatttacacgtatctggcgagtccgaccgtgggtatcataaaggaagatttaatcgacaagacgagcgctgagtatctggcatggaaagcggatgagatcagtctgcgtgactacctgtattatggaatcgcaaacggctgggtggataccacaaagctggagacggattccaagtattccaatgccgatgatacctttaaagtgctggtggattatgtgtttgcccaactgaaggaagaccggaattttacgaagaaaatctaccgctatctgatcaatgacgatgtcatcaccggacaggagctctgtctggccctgttcgatcagggaattctggaatataacgaggaagatatcaaccagttaaaggcgacaggcgacgcctatgcgttcctgatgaaaaagatatcgacgctggagatcacaccggcccagctggcgctggctccgtgtaacgcaggtgtggtggtaacggatatcaagaccggagaggttctggccctcgtgtcgtatcctggttacgataataaccggatcggcgacagcgcctatttcagccagcttcagaatgatttgtcactgccgttgtataacaatgcgacacaggccaagaaggcgcccggctctacttttaaaccgcttacagccgttgccgcactggaggaaaatgcaatcggaatcgaggatacgatcgactgtaccggacgatatgaagagatcgacacaccgatcaaatgctggatctatccgggccgtcacggtccgcttaacatggttggcggtcttcagaattcctgtaacttcttctttgcggaccttggacacaggctgtccatggatgccgacggcaactacgttccgtctctcggactggataagctgcataaatacgcagccctgttcggactggatcataaatccggcgtggaaatcgacgagctggagcctcagatttcagacatcgacccggagcgttccgccatgggacagggtaaccacgcctataccaatgtacagttatcgagatatgtggcggcgatcgccagcaggggtaatgtattcgaactcagcttactggataagacaaccgattctgaaggtaatctgattaaagattatacccctgagatttcttctcatattgacgcggcggattcaacgtgggatactgtacagcagggaatgagggaagttatcgccagtggtacggcgaagaagctgtttgccgatttggaggttccgatcgccggcaagaccggtacggcccaggaggcaaaaaataagcctaaccacgcgttctttatttcctatgcgccatataacaatccggagatctgtgttaccgtgaacattccgttcggatattcggcttccaatgccgcgaatatagcaaagagcgtgtatcagtactattatggagagattgatttggaatcaatcctgagtgccggtgcgcgtgatgcggcgaatgtcacgattcgcgattaagaagggtgagagaaaaggtcaggtggatatgatgcataataccgtagtgattaaaagcaacaaggcgggtatgaccgtatatctggaaccggaggtcccgtttcagacgcttcttgccgatatcggcaggaagttcggggacaacacgaagttctggggctcggcccagatgacgctgacgctggagggaagaaaactgacggcggaagaggaatttgcggttgtaaaccagattatggagaactccaatttagagatcgtctgcctcgttgatacggacgctaaccgcatcgaacgctgcgaaaaagcactgaatgagaaactgatggaactgtcctgccagacgggacaattctttaaaggaaatttacaggacggagagacgctggaatcggaagccagcatcattatcatcggagatgtggaacgaggctccaaggttatggcgaaggggaacgtgatcgttctcggcgcgctgtacggcaccgtatgcgcgggtgttgcgggcaatgagggcgctgtgattgtggcgttgaccatggcgccgacgcagcttcgcatcgcagactgcacctcacggcttgacggccgtgggaagaagctgggccgcggaccgatgaccgcttcactggatggaaataaagtctctatcaaaccaatgaaaaaaagtgtggaaatattccgaaaattaatgtagaatagaatatggattgaatcaggaggatatgagatgagtgaaatcattgtcattacttccggaaaaggcggggtaggcaagacaacaacctctgccaatgttggtaccggcctggccattctggggaaaaaggtagttcttatcgatacagatataggactcaggaacttagatgtggtcatgggactggaaaaccgcattgtctacaatcttgtagatgtggtagaaggcaactgccgtatgaagcaggccctgataaaagacaaaagatatccaaatctgtttttgcttccatcggctcagaccagggacaagacctcggtgaatccgggccagatggtgaaacttgttgatgatctgcgggaagagttcgactatgtacttctggactgcccggctggcatcgaacaggggtttcagaacgccatcgccggcgccgacagggcgcttgtggtaacgacacccgaagtatcggcgatccgtgatgcggaccgcattatcgggctcctggaagcctccggcatgaaaaccatcgatctggtggtgaaccggatccgtatggatatggtgagacgcggggatatgatgtccctcgatgacgtgatggacattctggccattgatatcatcggcgcagtcccggatgacgaggacatcgtcatatccaccaatcagggagagcctctggttggcataggaacaccggccggacaggcttatatggacatttgcaaacgtataaccggcgaaacggtgccgcttttgaatgtggcggcgcgtggagggtttttctttaagctttccaacctcttgaagagagcgtaggagggatgagatgagcctgtttcctgtattccgtaagaagaattcaggagagattgcaagaaatcgtctgaaacttttgctggttgcggacaaggcggactgttctcctgaagtgatgcagatgataaaagacgacatgatccatgtgatatcgagatacatggatgttgattccgacagaatagagatacagatgacgaagatgaagcagccggactgtgacagctatatgccggtgctttatgcgaacatccctattcgcgatatacctgacaaggggatatactgactatgttttttgactacaattttaaatactataattaccgtttggttctttacatggtggcgttatccgtcattgggattctcgtggttgcaagcgcatccggacaggattcctcgacggttacaaaacagataatcggtatcctggtgggatttgccctggccatagggctttccatcatcgattatcatagaattattaatttatatgcgctggattacgcagtatgcatccttcttttaggtgcggtgctggtgatgggtcacacggcaggcggagccacaaggtggatcgacgttccgggtatcggccggatacagccttccgaattcgtgaagattgggcttattgtattcttttcctggtattggaataaatatcaggaaaagatgaatatgcctgttatggtggggatcgcggccatactggccgtaatacccatcggtcttattttcgcggagccgaacttatccaccagtctggttgtcattgtcatcatactctgtatggtgtatacagctggcatcagttaccgctggatcggcggcgtgcttgcggttgccatacctgcaggcgcattatttatctatctgctgacgcaggggttgatcccctttatccacgattaccaggcgagacgtattctggcgtggatctatccgcatgcggaacagtacgcggagaatatgtatcagcagaagaattctatcatggcaatcagttccggacagcttcaggggaagggactttttaatacgactatcgcatccgtaaaggatggaaactggctgggcaccaccggagagacagatttcatctttgcaattatcggagaggagctgggctttgtcggcggggtaaccgtcattgtgctcttcggtctcatcgtatttgaatgtctgcgcttggcgtacaaatccagagacatggcggggcggctgatctgcaccggcatggcggcgcttatcggatttcaggcttttgccaacatcgccgtagcgacacagattttccccaataccggcctgccgcttccgtttatcagctcgggagtcagttccctgatcagcatctttatcgggatgggccttgttctgaatgttggattgcaacgcaaaattggtaattattaaggaggtatatcgttatgaatataggattagttgcacatgattcaaagaaaaaactgatgcagaacttctgcatcgcctaccgggggattttaagcaagcacaccctgtacgcgacagggaccactggccgtctgattgaagaggtcacgaatttaaatatccacaagtacctggctggtcatttaggcggtgagcagcagctgggagcccagattgagcacaacgagatcgatctggtgatctttttgagagacccgctctcatcaaaggctcatgagccggacctcgttaatatcatgaaaacctgcgacatgcacaatatcccgctggcaacaaacctggcgaccgcagagctcttaatcaagtctctggaccgcggtgacttagagtggcgtgagatgtataagtaggagtctgtaagtgaaaaagaaaattacgatgaaagccggctgcgcgtttttatgcgtgaccatgctgtcgggctgctccagcttcaaaaaactggataatccctatgacttcgcgcagaggacggctctatatgaaggaactgcgctatcggacagggcagagagttttgcacataatctctgtgtcgtcacggcggacactccatccacagatcaggcggttaccgcggaagcggcggcggtctttgacctgtcggacaaaacggtgattttcggaaagaatccctttgaaaagctgtatccggccagcatcaccaagacgatgacggctctgctggcgatcaaatacgggaatctgtccgacgaggtaacggtaccggaggaagcggtgattacggagagcggtgcgaccttatgcggcatcaaaccgggcgataaactgactatggagcagctgctctacggtcttatgctgccttccggcaatgacgccggcgctgcgattgcagtccacatggatggcagtattgagaagtttgccgaccgtatgaatgaagaggcgagaaagctgggagcgacagggactcatttcgtcaatccccatggtttaaacgatgaaaaccactatacgaccgcatatgatctgtatctgattttcaatgaagccatgaaatatcctgatttcaggaaggtgatcggtacgtcatcctatgacgctgtctacgcgacggcctcgggagatacgctgacaaagacctggaagcagagcaactggtatatgaccggtgaacgggatatgccggaaggactgactgcgctgggcggcaaaacaggcacgacaaaggctgcgggaagctgtctgatcatgggcagcagcggctcttcagggatggaatatatttccgttgtcttaaaagcccctgatagaacgggcctttacgataatatgtcaaatatattgaataaaattgtagattagtcgttgcgttttatggggatttgtactataattactttaatattaatagactttttatacaaatcatataactcaaggaggagatcgctatggtgcagataatagcaggaaaaaagggtaaggggaagacaaaacatctgttggatagggccaattccgccatcagggattccaagggatccatcgtctatttagacaagagttccaaacacatgtatgagttaagcaacaagattcgtctcattaatgtcaaagagtacccgattgaatcgagcgaaggatttattggttttatctgtggaatcatttcacaggatcacgatttggaaatgatgtttttagacagctttttaaaactgtcctgtttagaaggtgaagatattacagacaccatcacgactttggaaagaatcggtgaaaagtatcacgtgaccttcgttctcagcgtatccatggacgcagagaatctgcctgagaacgcgcaggccgatgtgattgtttcattataatcatacataaaggaattgtgggcgtatctgacaaatgctgaactgaatggcatttgcgggtacgtcccatttttttgcgaagatacgcggaggtatcagatgcttagtggaagtgctgcggggactgggaggagggattggctcatgttccctcgggggcagtctctaggcccggggaggacgttccacagggggatcgggcaaattccgccgaactcctgatgagttcgcctccatgtcccctttcgttcaggtgttgagcaccctccctcaccccctgctccacgtcctccccggaccaagagactgcgaccctcggtaaaaatcgccagtccctcctcccagtccccgcagcacttccactaagcatctgatacctccgctggcattctcctgctaaaaggaatttagctttctataatcataaagctggaaataatcagcggacggaaacagccttagcggaaacgagtcagggagcgggtggggagatttggcgatttttaccgagggtcgatgtgtcttagccgggagaggccattctgcagggggtgaaggagggtgaacaacgcccgagtgaaaggggacatggaggcgaactcaccaggagttcggcggaatttgcccgatccccctgcggaatggcctctcccggcttagacacatccgccgagggaacatgagccaaatctccccacccgctccctgactcgtttcctcacaacctagaaccgtccgcgtacatctttcacttgaactttttgcattttactcttataataactagaagggaaaggaggcgctctcttggcacaacagaaggtaaggccccgaaagaaggaggcggccccgaaaaaaaagaataagaagatcattaaataccggaagccgcttcatattaatgtcggaatgatcatcttcgcattgatttttgtttatatggtgttcagcgtctatacctacatacggagggacaaggtccagttctatgaagtacaggaaggaagcatcgtgaataataccgattataccggtattattttgagagaggaagaggtgaagaccgccgaccgctccggatacatcaactattatatccgggagggaaagagggcgtcggtgggaacgcggatctattccattgatgaaacaggaaatatcgcatcattcctggaagaaaatacagaagaaaatgtcacactgacagcggagaatctggctgatttaaagaaacagctgacagtattcagccttacgtacgacgacaaccgttttaactcggtttacgatacgaagtatacgctggaagcggacgtgatggaatacatgaattttaatgcgctcgataacgcgggaagcctccttgacgaggcgggatttaattttcagcaggtgcgggccgatgaggccggtgtcgtgtcctacggagtggactcttatgagagtctgaacgcttcaggaatttcggaagcggtattcgaccgcagcaagtatacgaagacgattacaaaagcagggaatctgattgaaaagggaattcctgtctataagatgatcacgtcggatcagtggtccgtggtatttccgttgagtgacgatgatgtgaaggcttatggggataagacaagcctgacggtcacattttccggtcatgacttaaaagccacaggcagcttttccatgcttactggaacggacggaaagccatacggcaaactggattttgataaatacatggtccagttcgcttcagaccgttacgcggactttgagattatttccgataaggtggacgggcttaagattccggccagcgccgtgacgacgaaggacttctatctcgttcccatggagtacttaacccagggcggcgacagctccgaaagcggatttaataaagaggtctattcggaatccggaagctctgtggtatttgttccggcgacgatctattattccgaggaggacaactactatattgagatgggcggagagaacggctttaacgcaggcgattacatcgtgaagccggattccacagaccgctaccagattggggcgagcgcgtccttacagggtgtgtacaatatcaataagggctatgctgtgtttaagcagatcgatgtgctggcgtccaacgacgaatactatacaattaagaagaatatgacgtacggtcttgctgtatacgaccacatcgtgctggatgcgtcgacagtcagtgaaggtgaattaatctatcagtaaagaggtgttacaatatggtaaaagaaaatctggaagaggtagaaagacggatttcagaggcctgcagacgggcgggaagaaaccgtgacgaagtgacgctggtagcggtcagcaagacgaagccggtgtccatgattgaagaagcgtacaggaccgggatccgcgattttggagaaaacaaggttcaggagctgtgtgaaaagcacgaggtgctggaatcagatatccgctggcatatgattggccatttacagagaaacaaggtacgccaggtggtggacaagaccgtcctgattcacagtgtggattcggtcaggctggcggcccagatcgacgaggaagcagcaaaaaagggcattaccgcagacattctgctggaggtgaatgtggcggcggaggagagcaaatacggcttccgcctggaggaaacggagcaggcgctgagagaaattgcggcattttcccatgtgcatattcagggattgatgacaattgcgccttttgtagataattccgaagaaaatcggccaatttttaaaaaattatatcaattttatgttgacatgcgcgggaaaaacattgataatgttactatgagtatgctctcaatgggtatgaccggagactatgaagtagcgatagaggaaggagcaactctggtaagagtcggtaccggcatttttggtacaagatataagattggagagaatgaaggatgagcataattagcaaattgctggagagtgtgcatttaaacggtgacgatgaagaggatgactactacttagatgacgattacgaagatgaagatgacagacctgccagaaaaggactctttgccaaaaaagatgaagatgactattacgatgacgatgaagagtacgatcagaagccgcgctttctatcacgttctccaaaggtagtaccgatgaaacagcgctccatgatggaagtttccatggtgaagccgacgtccatcgaggatgccaaagagatttgtgattatatgctggctggaaaagcagttgtgctgaatatggaaggaatccatacggaagtggcacagcgaattatcgattttacatcgggtgcgacatactctatgaacggcaatctgcagaagatctcgaattacatatttatagcaactccggaatccgtagagctttccggtgattttcaggacttgctgaataatggtacgctggatatgggcggaatgaatcttcgtctgtagccatgacgataaaagacaatcagattttaggtatagtacaagcagacaatcttccaaccaccggcctgccggcgccgcgggatttttcgtgacggggaccgtcaggaaggaagattgtttgctttctattttactttggaggaaccgtaatatggagaaaagaattccggtacatatggatggaagaaaagtatacgatattgtaatggaacaatccttcggtcagctggaggaagagctgcgcgggatgaatctggaggaacggaagatctgcgtcgtcacggattccaacgtggccccgctctaccttgaggaggtggaacggattgcctcggcctgctgccggaagacagagcattttatattcccggcaggggaggagaataagaacttaaatacggtaaaggatctctatgagaccctgatcttgaagaagtttgaccgccacgattatctgctggccctgggcggcggcgtggtaggagatttatgcggctttgcggccgcgacgtatttgagggggatctcctttattcaggttcccaccacccttctttcgcaggtggattccagcatcggagggaagaccggagttgattttgacgcctacaagaacatggtcggcgcttttcatatgccgaagctggtctatacgaatatttccacgctgaagacccttacggatgagcagttttcttccggtatgggagagatcatcaagcatggcctgattaaggatgcggcatactatgagtggctgggagagcatggggaggagatcggccggagggatctgtccgtctgtgaggagatggtcctggtcagcaaccggattaaacgcgatgtcgtggaaatggatccgacggagcagggagaacgggcgctgcttaattacggccatacgctgggccatgcaatcgagaagctggctgattttaagctgatgcacggccactgtgtgggactgggctgtatcgcggctatgggaatttctgctgccagaggtacgatggcggaggagaaactgctgcggttaaaagagatgatggggcgtttcggcatgcctctcacggtcagcggactttctgcagatgagatcattgaaacgacgaagagtgataaaaagatggattccgggacgatacgctttattctgctggaagaggtaggaaaagcttatattgacaagaccgtaacggatgatgaaatgaatgcgggactttcacgcattttggcataaggagacatacatgaaacagaaagcaaaacttgttacaggacttatcataggatttctggcggcaatcggtctggaccagtggacgaagctgctggcggtcaatcatctgatggaccggccggcctacgtcatatgggatggggtgttcgaattcctgtattcggaaaaccgcggcgcggccttcgggatgctccagggaaaacagtggtttttcctgattatcgctgtgattgtggtggccgcggctgtgtactccataagccgtatgccggctacgaagaagtatctgccgctgcatttgatcgccatgtttctctctgccggcgcagttggcaatatgatcgaccggttttcgaggggctatgtggtggactttttgtatttcaagctgattgatttccccatcttcaacgtggcggactgctatgtgacggtgtccatgtttatctttatcctgctgttcctgtttctgtataaagaagaggatttgaattgcctgtcaggccggaaggaaagggaagcggattgaaacagcagtttacggtaggagaggacgagaaagccatacggatcgataaatacttatcggagcaatgccccgatatctccaggtcctatcttcagaagctgctgaagacagaggcagtttttgtgggcggaaagccggttaagagcagctataagacggcggccggagacttgattgagctggagattcccgaggcggtagagcccgaaatcgttccggaggagatggaactggatatcctgtatgaggactccgatattattttaattaataaaccgaaggggatggtggtgcatcccgccgcagggcattacagcggtacgctggtaaacgggctgatggcccactgccgggcggatttatccggtatcaacggcgtgatgagaccgggaatcgttcaccgcatcgacatggacacgaccggtgttcttatcgtctgcaagaacgatatggcgcacaactccattgcggagcagctgaaggtgcactccattacgaggaaatactacgccattgcccatggcgtgatgggggacgacgaggggaccataagcgggcccatcggccgccatccggtggaccgaaaaaagatgtgcatcaatgagaagaatggccgcgaagccgtgacccattaccgggttttggaacgcttccgccagtttacgtatgtggagtgccggctggagacgggacgtacccatcagattcgcgttcacatggcgagtatcggccacccgcttctgggtgacgcggtatacggtccggccaagtgtccctataagcttacgggacagacactgcacgcaggcgtgctgggaatcgtgcatccgagaactggggaatatatggaatttacggccccgctgccggagtattttgaagaattattaagaaaattacgtaccacctagaactctttctgggtggtatttttaaagaaactgttaagaatcaataaatatatagatttttctgaaactttgatgtataataggcatataagataactggaaggagcggtctatatgagcggaaatttagtaattacaataggaagacaatgcggtagttccggtaagatcatcggacagaagttagccgaggagatgggcgtgaagtgctacgacaaggaattgctggcactggcagccaagaacagcggtttatgcgaggaattatttgagactcatgacgaaaagccgaccaacagctttctgtattccctggtaatggatacctattccatgggatatacgacgtccggctatatggatatgccgattaatcataagatatttcttgcacagtttgataccatcaaacagctggcagaacaggagtcctgtgtgatcgtcggaagatgcgccgattatgcgctgtccgattatccgaaggtagtgtccgtatttatcacggccagcgacgaggaccgcatcgcttccctgaagaagctttacaatgtggatgatgcaaaggcaaaagacatcatggtgaagaccgataaaaagcgtgcaagctactataattactactccagcaagaagtggggcgatacgagaagctacgatctctgcatcaaccggagcgcggtaggcgttgacggcgcggtgaagatgatccgtgcattcgcggaaaccaagcaggagtggctgaataagaatacttaaaccaaccgatgtgggtcccggaaacgggagcatcagggaattaaagacccgccgctcgcgggaagaacggggaacggccgcaggatcaatcattgattctgcggccgttcttcgttcttattccacggtaacggattttgccaggtttctcggctggtccacatcgagattcttgccggtggaggcgtagtaggcgatcagctggagcacgaccgcgatagggaagacggtaaaacggtccccgatcttcggaatgcggatatgaatatcggcgactcctctatctaagacggcgtcctccttggtgatgagaattacgaaggcgccgcgggccttgacctcgcggatgttggagatggtcttggcgaagactttttcctgtgtggcgatagcgatgacaggtacctcctctgtgatcagagcgatggtaccgtgcttcagctcgccggccgcataggcttccgcgtgaatataggagatttccttcagcttcagcgcgccttccagggaaaaggagtaatccagtccacggccgatgaaaaacgcatcgggtttgttgattaaatgtgtgaccagagccttgatggaatctttctgagcgatcatggcctccatggcgggaatggcctccaacagcttcttcatgaactcggtggcctgggggacgctgtatttgccccgtacaagggccatacggcagccaatcatatagagggcggccagctgaacggaataggctttcgtgctggctactgcgatttcagggcctgcatgggtatagagtgtgtaatcgctctctctggcgatggtggatccctttacattgacgacggataaggcggccgcgccgtaattcttcgccagccgcatggcggccagcgtatcgatggtctctccggactgggagatgatgatgacgagggtgtctttaccgatcagcggctcctcgtaacggaattccgacgctaccgacaccgtgaccgggattcgaaggaggggctccatcatgctcctggctgccatcccggcgtgcatggcagtgccgcaggccacgatgtggatctgggagcaggaagtgaacacgtcatccgggatctgatcgtcggtaaaatcgggcagccccttactcagacgggggagtatggtgtttctcagcgcctccggctgttcgtggatttctttcagcatgaaatgggggaagccgtttttcatggcggcatccatgttccagtttacttccatcagttccggcatctcttcatggcgctgcaggttgtagaggtggaccttataggaggtcagacgcacgatatggtcttcggggacgacaaaatactgtctcgtataagggatgagcgccgttaagtccgaggccacgaaggagcctgaacgcgtgtaagccgctacgagggggcttacattccggatggcataaatctctcccgggtagtcttcgaacatgatacagaagctgtaagagcccttaatcagggctacaagcctggtgatggcctccagcgggtcaccctggtagaggctgtcgagcacccaggcggccacctcgctgtccgtctcggaatgaagcttagcttccaagtgaaactgttcggtcagctgatggtaattctcgatgatcccgttgtggaccagagtgacttttccggcctgatggggatgggtgttctgtgttgttacaccgccgtgggtcgcccatctcgtatggcctaagccgcagtgggagacgtctgtgatccgttccatcgtctcctttaagtttgccaccttgccggtccggcggaccaggcagatgtgggagttctccatgcaaagcgcggctccggcgctgtcatacccgcggtattccagctgggaaagtccgtttaaaagtatctttttagagtccaggggtcctgtataaccaataattccacacatagttgttaatctcctctcagtttttctgaaaaaaggccgcacaaaaaagagactgtctgtttctcgtctttgagaacggcagctttttcagcttcggttttaatttttgtctgtcagtctgttattttagtctgttatgctgtttagtcgcatcagtccggttcctgcgcgtttgttttgcggttacccgcatatttcgttcaggatacacgcccggatggcatggaagagcatccgccgaattcttcgataaactcttctcctcgttaaccttcagtaccggtcttcaccgttcacgctcgtacttacaggtgcatggcgcttagctttgctattgaaatttatgcctcctcataaatttagtctattatatcccgaacaactttgtgcgtcaatagaaggtttacaaccattttacgaaaactttctttttcattttacattgcccttataaaattagagcataccggaaagaaaaggaaggaactgttatggcgagtttatcgttagtaaatgtgtgcaaaacctataagaacggttttgaggcggtgaaggatgtgaacctcgatatcagggataaggagttcctgattctggtgggaccgtcggggtgcgggaagtcgacgacgctccgtatgatcgccgggctggaggacatttcctccggtcagctctggattgacggtcagctggtcaacatgctggaaccaaaaaacagagatttatccatggtgtttcagaactacgcgctgtaccctcatatgacggtgtatcagaatatggccttcgggctgaaggtgcggaagacaccgaaggaggagatcgacagacgggtgaggcaggccgcaaaaatcctggatatcgcccatctgctggacagaaaaccacacgcgctgtcgggaggccagaagcagagagtggcgattggcagcgtgattgtaagggagccgaaggcgtacctcatggatgaacctctctctaacttagacgcgaagctgcggtcgcagatgagggtggagctttcgaagctgcaccgggaactgggtgctaccgtgatctatgtgactcacgatcaggtagaggccatgacgctggggacgaggattgtcgttatgaggagtggtaagattcagcaggccgctgcccccggggatttatatcagaatcccgtgaataaattcgtggctggttttatcggttctccggcgatgaattttctgccggcgtgggtggaacggcgcgatgagagagtctgcctggaatttggcagcagcagactgtatgtaaaccgtatgtgcgcctcccggctgatcgaaggcggatacctgggaagacgggtgtatctggggatcaggccggaagactttcatgagacgggacccggggaaaatgcgcttccgctggaagtggaaatcaaggaaatgctgggtgccgaacagcttctctatggaaacagcggacgaaatgagctctgcgtccgtacgaaaccggatttcaaagcggaaccgggaagcacggtgacggtctttgtcgacatggaccgcatcaagctgtttgacatggagacagaagaaaatatttcatttcattaggaagttcgtcctatgaaatgaaagccctacggggtatgcgcactacgcgctgaggaaatatggccgctaaagcgaccgcgctccggcgcgcgagtccggcaaaacggactctttattctatctgtaaggagtgagtattccaatgaaagtgaaagcaatggtaaaaaaggccggcccatacgcctatctcgtcccggccctggcggttttcgcggttttcctgttctatccctttttcaagaccatctatttaagcctctataaaacgaacaaaatggggcaggccaggctctttgtgggagccggaaactataaggacttattaacgtcctcctcatttttaaacagcctcgtggtaacgggtgtgttcgtggcgattgtggtctctgtaagcatgctgctgggactctttacggccctgctgtgcaataagacatttccgggaatccgggtcttcagcacagcctatgcgcttcctatggcgatcgcctccagttcggcagccatgatcttcaaaattatgcttcacccgtcgatcggcattgtaaacaagctgacgggacttaatatcaactggatcagtgatccgaaatatgcgcttctctgtgtggctcttgtgaccgcatggctgaacagcgggatcaatttcctgtatttcagtgcgggactcagcaatatcgatgaatcgatctacgaaagggcgtccgtggatggcgccggcgcgtgggccaaattctttcatctgacactgccgggactcagccccattctgttttatacgctggtggtcaatatcattcaggcctttcagtcttttggccaggtcaaggtcctgacacagggcgggccgggagaatccaccaacttaatcgtatattcgatctaccgggatgcgttctttaactaccggttcggaggcgcggcggcgcagtcggttcttttgttcggcatcattatgattctcacgctgtgcatgttccggctggagaagaagggggtaaactactgatggattctaccataactgcagagagaaacaaaatgagcgaggcggagatcgccagactctaccaggaggccaatcagaaggccctgatcaaaagaagagtggaacggaccgcgctggtagctgtcaacatcgtggcggcttttgtgatcctgctgccgcttttctacgccgtgagcatcgcttttatgccctccagtgagctttttaccacggaacttaatctgtttccgtcgagtcctaccatggataattttaaggaggccatgagaaaaattccgctgggacggtttattctcaactcgtttatcgtggctggcgccatcaccttcgggcagatcatatcctgctctctggcggcattttccttctcttttttagactttaaaggcaaaaatgtcctgttcatgattgtcatggcgacgatgatgataccgggcgaggccaccatcatatccaattacttaaccgtcagccgtctcaaatggctggacagctatcaggtgctgattatcccgtacctgacatcggccatggggatcttcctgtttcgtcagttttatatgacgtttcccatttcactgtatgaatcggcgaagatcgacggatgctcgaatataaaattcattttccggattctgattccgcttacgaaggcggcgatcggagctatggcggtctatacctttatcaacgcctggaacatgtatatgtggccgctgctggttaccggctctgattccatgcggaccgtgcagatcggaatcggaatgctggacagtgtggattcccagtccatatccatgatgattgccggcgtggtgatgatcattataccgtccatttcggtatttttgatcggacagaaacaattgatccatggaatgttttcgggcgccgtcaaaggctaggtccggcggtattagcagaccggcgccgagtgaggcgcacggcaatcccgatgcagataaaataagaaagaaaattctggaggaataagcatgaagagaaatgcaattgctgcctgcatggcccttatggtggccgcaggaagcgtgacaggctgcagcagccagacaggaacgaaagaaagtgatacgacggcacaggatacggctgcgggaacagaggcggtgaagagcagcgcggcagagaataaggcggatggtgtaaccatcaccttctggcattccatgggcggcgtgaacggtgaggcgatcaatactctggtggagcagtttaataaggagaacacagacaaaatcaccgtggaagcccagtaccagggcagctatgacgatgcgatcaacaagcttaagagcgcccagatcggcagtatgggggccgacctcgttcagatctatgacattggcacccggttcatgatcgattccggctgggtggtccccatgcaggatttgatcgacggggaaggatgggacttaagccaggtagaaccgaacatcgcggcctactatacggtggatgacgtcctttactccatgccgtttaattcctctactccaattctctattataacaaggacatgtttgagaaggcgggaatcacggagataccggacagcctgccgaagattgcggctgtgggagacgggcttctcgaaaagggaggtgccggagaggtgatttccctgggaatttacggctggttctttgaacagtttacttccaaacagggcgcggactatgcggataacggcaacggaagaaccgcggcggcaacggcagtcgattttgacaaaaatggcgcgggcgttaagacgcttaccgcatggaaggcgttggcagaccaggggtatgcgcctaatgtgggacgcggaggagatgccggactggctgatttcagcgcaggaaaggcggctatgacgcttggatctaccgcttcgttaaaacagatcttaaatgacgtaaacggcaaatttgaagtgggcaccgcttatttcccgaaggtgagcgacgaggaccagggcggcgtgtcgatcggcggcggttccctttgggcgctgaacaacgaagatccggcgagacagaacgcggtctggcagttcgtgaaattcctcgtttctccggccagccaggcttactggaattcccagaccggttacttcccggtaaccgtggctgcacatgaggagacggtattccaggagaatattgcgaagtatccccagtttgagacggcgatcgaccagcttcatgattccacaccgcagtcagcgggggcgctcttaagcattttcccagaggcgagacagatcgtggagacagaaattgaaaatatgttaaacaacggcacttccccggaagatacggtggcgaagatggccgatagcatcaataaatccattgaggattacaatctcttgaacgagtaaagaaaaggagtacgggacgatgaaaacgaaggtttgggcacacagaggggcgtcggcctatgcgccggaaaatacgctggaggcatttgaactggcggtcagccagggcgcggatggagtggagctggatatccagatgacgaaggacggctctctggccgtaatacatgacgagaccatcgaccgggtctgcgacggcagcggctgtgtggcagattttacgatgaaggagttaaagaagttccgatgcagcaggctgcacccggagtttgcggatgcgaggattccggagctgggagaggtgctttcccttatcaaaccttcgaagctgaccgtaaatatcgaactgaagacggggatcgtccgttataaggggatcgaagaggcggccgttaagctggtaaaggagatgggaatggaggaccgggtgatctattcgtccttccaccatcccagcctcttaaaggtgaaacggctggacccggatgccaaaacgggactcctgtattcggatggctggatccatgtggcttcctacgggaagaagctgggagtggatgcgctccatccggcactctaccacctgcgttccgggaagcttctcaaggaggcgaaggagaagaaactgccgctccacgtgtggactgtgaacgaggaaggggccatgaggatccttgcggagcagaagatcgccgccctgatcaccaactacccggatgtggcgctgcgcgtggtgcgcgagatgagccgatactgaatcttaataaacaattaattctttttctctgttttttgacgggacaatatggtatattcttactttagaaacgataacaggaagatgaaaaccgatgaaacgaaacagaaccgtcagaaaccagactatatccgccatttttatggctcttgtgggaaccgcgattcatgcgggggcccagtcttatctttcatcctatgatataccagaaaataaaccggcgcggcctgtggtctccataccgcctgtcgtgccggaggaaacaaagccggtggaaactgtgccggagacggaggcggaagaagtattttcgccttctcttgctgcgctgaatctggcttatctctatccggagggcgcagaccgcacggatgcgcagaacagtctggcggggcagatcctccgtgaattatctgtaaaagactcggaatggctggcctccatctatgatttatccaaccggaagccggccgaagccgctgcaaagctgggacttcccgcggatcgtgtgcggggactctacaatccgcttgatgaatcgcagacagaagacaatcctgacagctggctgctctccgagtggtcgcgcatcgacatggtctttactgatgaaaatggaaacagaattatggctgattccaatatcaaggaaatcatggccatggcaaatacatacttttactacacggacccagaggacagtgatgcctttctgaattacgtgctgaatctctgggacaagtctcactcgattcattattccatcggagaggtgtattactgtgacggctgtctggaggaggcgtccggtgatacggaagcctctgaggcagcaggaaccgccggttcgggagagaacccggagaatgcatcaggagacggtttgacgggctctgaggaggcgcagagcggagcggacgggactgcggctgcctccgcttcagatcattcacaggcgacaccggaaacagcggagattgggccgggagtgccgtctgcttcagaggcaacggctttgggagaagacaacgggacagggagtggaatggcggaaggggcagcagaagccgtggaacaggaggccaaagcggagatcggccctggaatcgcactgatggaagcatctaaagccgctgagacagaaacggcagaggaaacggataaggaagaggaaagggataaggaagagaaaacgcctctgacgaagtgtccggggcatgtggaccttcatattactgcggctgttgcaggcgcctcttcatcggaaaaatcgctgttctccatagcggaggaagtgacagccgccgaacaggaagctggttttcccggctggaccgaggaacataaaaacgcggtactagaactggccgcccaggactggaaggctgcctatgggctgacggtttcgtccacctatatttcgaatccgctttcgcagtctgagacggaatactacttaagccttcttcccgcggacacctctctggaacgaaggcgcctgatccgctacgccctgtcttctgtgggaaaagtcccgtactactggggcggaaagccatcggcgccggattacgacgggaatcattttggctccctggcggctgccgatgagaagggccgcacgatgaagggactggactgctcgggctggatcagctgggtatactggtcggcgctgggaaagaggcttcctgcagagagcaccgacggactcgccggctgcggcaccgctgtggcgagagcggatttaaaaccgggagatattattgtccggctgggcgacgaagggcatgtcgtcatgttcctggcatgggaatcggaggatcggatgaaggtggtgcatgagtccagcggaagcgtaaataatgtgacagtcagcaccatgcaggccagctggccttattatagaaagctgattgactgagaaacgtaagagaaaagcaagaaacagtaagattgtttctggtagaataagtaaggtttgccaaagtaaatcacaggaaaggactgaataacctgttatggattatgaggatgaattagaccgtatgcgtgcacagaagaggcgcagcagcggtgcaaaaagaaaggtggacaacttaagcggccgtgcatattatgagaaaggtgacggtagaaacccaagagtggaatatgcgggacgccaggatgtacaccagaagctgcgggaggaacggatccgcaagaagaaaaagaagaaacggatgctgatgatcgaactggccgttttggccatattggtggtgagcgcatttttgatttttggaaagggaacgaatcagaagggatactggacgattgcaatattcggtgtggattcccgcgatggaaaactggaaaaaggcgccctgtccgacgttgagatgatctgcaacattgacaaggccacgggggagatcaagctggtgtccgtattccgtgatacatatttaaagattaacagcgaaggaacgtatcataagatcaatgaggcctattttaagggcggccataagcaggcagtagaggcgctgaacgaaaacctggatttaaagatcgatgattacgccacatttaactggaaggcggtggcggaggccatcaatatcctgggcggcgtggatattgagattacagatgcggaattttcttatataaacggttttatcactgagacggttaattccactgggatcggctcctaccagctgaagagcgcgggtatgaatcatctggacggagtgcaggcggtggcgtatgccagactgcgtctgatggataccgattttaacagaacggaacgccagagaaaggttgtgaccctcgcgctggaaaaggcaaaacaggccgattttggtacgttaaagacactggtttccacggtattccctcagatttcaacgagcattgggatcgatgatttatttacgattgccaaggggattacaaagtaccatataggcgagacagccggtttcccattttccaggacaaccatgagaatcgggaaaatggactgcgtaattgcgacgacactggagagcaacgtcattcagcttcatcagttcctgtataatgttgaaaattactccccgtcttccacggtgaaatccatcagtgcgagaatatcggaggagagcggaatcagcgaaccgggaaagaacgctcccacaggcggcggctctacgaaaaagaattcgggggcagcttctgcgcccaaagagacggctccgcctgagacggaaagcgtgacagaggcgagcgtggaagagaccatggaaaccacggaggagaccgaagccgagacaacggaggaagagaccaccgcggctgagaccaatggtgacggaagcctcatcggtccgggcgccggccttgacggtgcggcgaaagaaccggaggagacgaagggaacgaaagagacgaaggaagaaactaaggcagagacgaaggcctctgagccggctgcgcctgagacgacgaaggctccggagacaccagccccctcagcgcctggtgataaaggtccggcaggaggttcttcgggtggtccgggagaggtgggacctggggtctgatgcagtgacaggaatcgtgaaaaatagcggtatgaaatagaatcacagccgacaggttgacataaaaatattatgttgacctgtcggctgttttttatggaaatgaaaaacgaaaactttaagaaaacttaagtctttctcttcctttatctttagattccgggtgtacgattaagaaaaagaagagaatgaaaatggattggagggtattatgaagaaaatcatctgtattctgagcacaatgttcgcggcattgctgttgatggcctgcaacggcctgtcgttcagcggcagcagaatggggaatggcagccagcttattatgaggtacagcatatttaataccacggattcccagtactttgagatggatcagggggacgtgatcgacgccgatatcgtgagtgattcgggaaagctgtcggtaaccgttcagagtgaagacggggaaacggtatatgaaaacgaggacgtccccacaggcgcattccagatcgagatcaagaagaaggggatatataagatcaaagtaaccggaaagaaggcgaagggcagcttaagctttataaagagcacggagcaggataccctggaagccaatctggcagcgctgagcaattcttattatgaggggcagtcttcacgggcttatgagatggtgcaaaaatccatcttcaaaaaattgctgttaaacggatggctcgatgagataagcggcatggaaaacgccaggtggaattacgatacctttacgaaatatacggttttagaccgtgatccggttcctgatgaggagcagggggagctgtactgctgtacattttccgccgataacggcagatatggttacatcgtgatatcgtacagcggcgacggcctgtcaaaaattcgcgcggttgaaactccatacctctatgatttcttttctgaacgggatcagattaagaaggagctggagacgtccggagtggatttatcaacggcctccgcgcagagagcggaagcattgggagaggacggcagcgatccggcagaaggaatttactttaccgacagcaaaggaaaccattatttttacagcttttcatagtacatgtaagtgggaaatagaaaacgaagactgtgcagcaggctgattttagacaaaaatatatgccattctggaatttggggagtgtccatgaatggcatgtaaaagaagagctgaatgtagtataacacaaaaagttacaaaagtcatgctaaaaatgcgttaattatcaaaaatgtaaccaaaaccgctaattatatagcaaaaatataactgtatggcaggaatatggaccgaaaaattcatatttctgccatttacaatgtgcttgacaaatggatggggctgcgttaagattagtgtaaagtatgatagtaacaaaataataataactaaatgataataactaaaagaaaataagagagacggagaaaggggacgccatgagaaacggaatctacgatctggaaactttaagaaaggcctataacagaggcgatcatttaaaatatctatttttctggggacacacgccgcctgcggacggacgcatcaacgagtcgtgcttcagccagtggtggatgtgccggtttgcggttgacggtacggaatatacgtgtgcggagcagtttatgatggcggaaaaggccaggatgtttggtgacagggagatgctctccatgattcttaaggcaaagcatccgaaggagatgaaagcgtacgggcgtgccgtcaggaatttcgataaggataagtgggacggcgcctgctatgagatcgttaagcgggggaatctggcgaagttttcccagaatccggagttgtgggattatttgaagaccacgaaatcgcgaatcctggtggaagcgagcccgagagaccggatctggggcatcggtatgggaaaaagtaatcccgatgcggaatgtcctgtgaagtggcggggcacgaatttcctgggctttgccctgacggaggtccgcgaccttctcctggaaagggaagagggggaaaacggatgaagaagaaggagctgcgtgaccggaacgggctgacagaggctgagtatctgagcagttacgaaccgggcgattacgtgcggccgtctgttgcggccgacatggttatctttaccgtcatggagacggaggaggagaattacaggaagcttccggaaaaggagctggaagtgctgctgattcagagaggcgtccacccttatctgggctgctgggcgcttcccggcggctttgtgcggcctgatgagacgacggaggcggcggccaagcgggagctgaaggaggagacaggagttgaccacgtctatctggagcagctttataccttcagcgagccggagagagacccgcgtacatgggttatgagctgttcctacatggcgctcatcgactcttccaaggtccgggtaagtgccggggacgatgtagatcaggcggtctggttccgtacttcttttcacttaatggatgaacacatcgagtacagaaagaacatgacctacgacggcatgaagacgatacgcacaaagcggtatgaactggaattaagccatgaggacgtggtgctgcgttccatgatagaaaaaaagattgtaaaaacagaacacgaaacagttacggaatacagaattctggaaaatgacgggctggccttcgaccatgcgaagatcattgcctatgcgctggaacggctgaagggaaaggtggagtatacggatctcgccctccatatgatgccgaaggagtttacactgacccagctgcagcaggtgtatgaggtcatcctggggaaaacgctgctaaaggcggcgttcagacgcaagattgcccatctggtagaggaaaccgattccttcacggagaatgagggccaccgtccctccagactgttccgcagaaaattggaggaagaataatggacagaaaagcgacggcgcgggaaacgctccggatcctggaacagggatattatctgtatggagaccagaggatttccatcgaagaagcacatgaaaagtcagtaaaggagagcgtcctgatcaccccggaggagggggcgcagcttttggcggcgtatgaagaaggcagccgcagaggagatgaaaagtgcggctgtaccgtgggagacatctccaccgtggaggcagcctggaagttatctctggagggaaagaagaatatcgccatcctgaattttgccagcgccaagaatcccggcggcggtttcataaacggagccatggcccaggaggaaagcctggctgcctccagcgggctttacaggacgttgaccgtccacgaggagtattacagaaacaaccgggcgtgcccgtccatgatgtatacggaccacgccatctattctccggaggtagtattcttccgggacggaggcttccggctcctggagaaaccgtttacttcgtcggtcctgacactgccagccgtcaatatgggccaggtcctgttaaagggcgaagactgcgacacggcggaacgcgtaatgcgacgccggatgaagctggctctcgctgtttttgcagagagaggggcaaagaatctggttctgggagcgtacggatgcggcgtattcagaaacgatccggtaaaaatcgccgcatggtgggaggagctgctgagcggagagtttaaaggcgtttttgaacagatcgtatttgcggttctggacagaagtaaaaataaggcatgtctgaacgcatttgcatattatggggttctatgctaaaattgttacaaatggccaaaattatgagcctttggcagacaggtacggcacctgcaggaggggtaaaggaagatgaacgaacagataacagccagggaatgtgtgaaagcgctttgctgcgcctggtttgaacgacgcagtatggaggagaccattgcttttttcgcagatgacgtcatgtttatcggtaccggtgaggaggaagcggcccacggaaagaaagagatggccgagtatatcgctcaggacatccaggagataccggaaccgttcgcggtgggagttacgatcgttcacgagcagcggcttggagaggatctccggaatttctccattgggctgacgcttaaaaatactctatattcctggctcctgcgcggcttcttcattctgatgcgggagcacggtgtgtggctggttaagagccttcattttgcagaacccagcgacaagcagggggacgaggaacactatccgcagacgcttgtcatggagaacatcgcaaaacagcgtcagaagctgctggacgattctctgccgggcggcatgatgggcggatacatagaggaaggatttcctttttactttatcaaccggcggatgctggattatctgggctatgagaatgatgaggcctttattcgggacatcggcggaatgattaccaactgcatgcatccggaggaccgggagcgggtggacagcgaggtggccggtcagatagcggtctcgggggagtatgtgaccgagtaccggatgaagaagcgcgacggctcctatatctgggttcacgaccagggacgcgaggtgacggcggaagacggcagacctgcgatcatgtcggtctgcgtcgatgtcaccgctcagaaacaggccagggaagaggtcctgaatctttataacaacattccaggcgccgtgttccggtgccgttttgacgcggagttttctgtgattgacgccaatgacggtctgtttgaattcctgggctataccagagaggaattcgcggctatggggaataccatggcttccgtcatttaccccgatgacctggagattatggcagaccggctgaaccggcagctgacccatggcaacacgatccacaacgagaaccggctgatctgtaaggacggaacggtgaagtggatctccatcaaggcccagctgctgaaggaagagggaagtgaacagtatttttactgcgttttcgtggatataacggaggaaaagcttctgcaggaacgtatgagggagctgtacgagaaggaactgacctattttgcggagatgtcttcctcggacggcagcatccagggacgcatgaacgtcacgcaaaaccgggtggagagctatctgtccacctcggatatcatcctgacccatacgggaacttcctacgatgagacgattgagagtctgtcctcctgtgccgtggacgctgcatatggagaggaactccgctgggcgctgcggcgggagaagctgctggaagactatgcggccggaaagacggattatcattacgagttcctgtgcagatataacggcggaaccttctgggggagcatgaacttcaagtcctgcttaaacccggagaccggcgatattatcgttttcttttatgtcctggatattacggagcagaagctgacggagcgcctgctcaagaggattgcggagctggattatgacagcattacggatgtcgatatccggcggaatacgtaccagcaggtttctttcaacagttcggagaagaatctgattccgtggcagggagaattccagaaagagattaccaagattgcggaacagtatatggacagcgcggcgaaaaaggagtacttaagccagctggacagcgaatatatgaaggagatgttaaaggatcagaacacttactcctttgtggcggagatgcgggatgagtacggcaacgtgcgggtcaagcggtttaaagtgttctatatcagcagagaattggggcggatctgcatcgtgcgcaccgatgtgaccgatatcgtgcggggcgagcagcgccagaaggaggagctggcggctgcgctggcggccgcggagcaggcgaatgcagccaagagcgatttcctctccaggatgagccatgagatcaggacgcccatgaacgccattatcggcatgagcaccattgcggccaaatccatcggggacgacgatcaggtagccgactgcatctccaaaatcggcatttcctcccgcttcctgctgtcactgatcaatgatattctggacatgagccggatcgaaagcggaaagatgctgctgaagaacgataaaattcccatggaagaattcctctgcggaattaattccatctgttatccgcaggcggcctcgaaggaggttgactacgagtgcattgtggacccggttctggacgattactacatcggcgacgccatgaagctgcagcaggttctgatcaatattttgaataatgcgatcaaatttaccggcgagagcgggaaagtcaccctctcggcgtctcagcggagcaagatgaagaacgatgccgttctgcgctttattatcaacgatacaggcatcggtatgagtgaggagttcctgccccatatttttgagccgtttacccaggagtccatcggcactaccgcattatacggaggcacgggcctggggatggcgatctccaagagcattgtggatatgatggatggcaagatcacggtgcgctccatcaagggaatcggcacggagtttaccgtggatgtgaaactggggatcacggaggaggagaagctgcgccataaccagaagaagcagaattttaatttctcccacttaaagacgctggtcgtggatgacgatgtggctgtctgtgagagcgccgtcgtgacgcttcatgagatgggaatcaaggcggaatgggtggacagcgggcgcaaggccgtggacagaatcagggaatgctggggccggggcgcctattacgatatggtcctgatcgactggaagatgccggagatggacggaatcgagacggcgagacagatcaggcagattgtggggcctgatgtcacgatcattatcatgaccgcctacgactggagttccatcgagcacgaggcgaagctggccggggtcaatctactgatgagcaagcccatgttcaagtcttccctggtgtccgcgttttcaagggcgctgggagagaaggatgagcaggaacaggtatccgcaggctttgatttcgatttttcagggaaacgcgtgcttctggtggaagacaatgcgatcaacaccgaggtggcggctctgctgctcacggatcagggcttcgaggtggatacggcggaaaacggactgcgggcgctggagatattcagcaaaacggagcctggctattacgacgccatactcatggatatccgtatgccgatcatggacggattgtcggccacggtcaatatccgccatttgagcaatccggatgccagggatattccgattattgccatgacggccaatgcctttgacgatgatatcgaaaagagccgggcggcggggatgaatgcgcacctggccaagcccatagagccggaacggctgtatcagacactgtatgattttatctttggaaaggaggagtgacacagatgcgtgaagactctctctccatgaatcagccggctcctccagagcctgaacggacatcctgcgtcgaagaaacgatgcaggatgttttcgatgcggttcagggcggtctttcggtctaccgcgtcgccggaaaacagtttgtgccctcttttttctcggatgtgctgggcctcatctgcggccgggacagggaacgggtgatggaggcggtatgtgcggcttatgacagcggtgaattattggacctttcatgcaggatcaggcagaacaacggagatcctgtgtggattcgcctgaatggacggcgggcagcaggcagggataaattttgtattgtgtatacagtcatgtccgcagagaaccgtctgctgcagcagattgcagatgagacggcggacggaatctatgtgattgacagggagacgtatgagcttctctatgccaatgaatcaggccggtttcgcggggaagagcggggcagagtcgggcgggcgtgttatgccgctctgtacggcagaacgtcgccctgcgagttctgtacgcttaccagccatgagccggatggaacgtctcatatcatggagacgggagagacggggcggttttacagcacccatttccgtgaaattgactggaatggaaggccggccattgtaaaatacgtccgggatgtcacggaggaagtgaccaacaggagagaacgggaacgtctggagcagtatttccagacggttttaaagcatcttcccggcggtatcgtggtggttcattatgagaaggacgggacgctgaagccggaatttatctctgagggctttgcggacatgacggatatgacactggaggacgcatggcagctgtatgagacggatgccctggccggtgtccatccggatgacagagtccgggtgaacgcgcagatggaggcgtacgtcgggggaaatgaccggaacggtgagatcgtgtaccgcctggaaaagggcagcggcggttatgtctggataaagaacagcctgaccatgaaccgtgacagcgaggagaagcggatttattcggttctgcgggatatgacaggggaactggaggagaaggagctgatccggaagcagtacaaggatgtgattcttcagcattaccatacacaggattccaacgccctgatcgtgggacactgcaacattacgcagaacagaattctggaaatcatcgattacacgggagtgaacccgctaaaactgtttggaagcgtgcgggaggagttctttaccggaatgggcactctgatagtggatgaggaagagaggcgcaaattctatggtatctatttgaatgagccgtcccttgccgcgtttaagcgcaaagattttgagcagtgtatggagtgcttcgtccagattccgggagaggcgacgggccggtacgtgcagattatgatgactctggtggatacgccggacagcagcgatgtcaccggtatcctggcgatcaccgacatcaccgatcagacgattaacgaccggattctgcatcggcttaccaccgccagccatgactttgtcgtggatattaacctgacggcagactattaccgggtacttacgcaaagcgacagcatcttatgtgttccgccgccccagggaaactattcggagtggacctcctgggtgcagacctcgggcgttatggcgccaagagaccgggagcggtataagtacaacatgaatccggagtatgtgataaaaaagctgcagtcagggccttattccttcaccttctcccttatggatcaagacggggatattcgcacaaaaagtataactctgtccccggtcgacctccgtcttggaagaatctgtcttacgagaacggatattacggattctgtcagggagcagcagggaatgctgcgtctgatcgcctatacctttgaactggccggatttatcaatctggccagcaggagtcttaccatgtacacgagggcgacggttctggaaaatcttcctcccgcctattccgagtgctatgaggaggcgattcttggatttatcgaccaatgcatcaccgaggaaaatgaggcggaagtccgcgccagattccgcatccatacgattctggaaggccttcgggagaagccggacggatacgatttccttctttcgtaccatacggatgagggggagcggtacaaacagatcaccgtcatgtggagcgatgtcaatcactcgacggtaggcctggtgagggcagatgtgacggatacgctgactgccgagaggaaggccaagaaggcgctggaagacgccctggccctcgcggaagaggcaaaccgggcaaagagcgacttcctttccaccatgagccacgatatccgcacgcccatgaatgcggtgatgggcatgactgctctggcgatcgcccatttaggggaccgggacagggtggcggactgcctgcagaagatatccatctcatccaggcatctgttaagtttgatcaatgatattctggatatgaataagatcgaacgttcccagattacgctgaaccgtatgaagatatccttaaacgagctgctggcgcagatgtccgcgatgatggcgcctcaggccagggcggcggggcttcagtttgcggtccatatggaagacgtgagacacaagcatttttacggcgattccctgcggttaaatcagattctgatcaatattctgggaaatgcggtaaagtatacgccggtgggcggaagcgtggagttccggctgactgagatttctccggtcgagccttcggcaaatgaggccggccgcgcccgctatctctttacgatcagcgatacgggtgttggcatgtcggaaacgtttctggcctgcatgtttgaaccatttatgcgcaatgaaagcacggaacgcatcgagggaacgggactggggctcagcattacgaaagggctgattgacctgatgggaggcagaatccaggcagaaagccaggtgggcagaggaagctgctttaaaatagaactggaattcgactgcctggaggcggaggaagaggccgcggcggaggctgaaaggaagacagagccagaggcggccaggtggaatgcattttcgcttgctgacggcgatacgtttgccggatgtctctttctggtggctgaggataatgcgattaatgcggaaattctctgcgagcttctcgccatgagcggcgccaggactgtggtaacgaccgacggaaaacaggcggtacgcgcgtttatggagtcggaaccccatacatacagcgctgttctgatggatgtccagatgccggggatgaacggatatgatgcgaccagagcgatccgcagcatggagcgggaggatgcggcagctattccgattattgcgatgacggccaatgcgtttgccgaggacatacaggcggcagcagcggcgggaatgaacgcccacgtggcaaagcctgtcgatatggcggtgcttcgggagacccttttgagggcacttaagaaaaagacagtttgggaggcagaagatagtgatagataatcaaaaaaccgttttatttgagcagatgccagtgccgaaggcggttatgaaactggcagttccgactattttaagttccctggttatggtcatttacaacctggcggacacgtatttcgtcggaatgatgaacaatccggtgcagaacgctgcggttacgctggcggccccggtgctgctggcatttaatgcggtcaacaatctgttcggcgtcggcagttccagcatgatgagccgcgctctgggacgaaaggattacgaaacggtccgccagagctcagcctttggcttctactgcgcgctgtttttcggcttcctgctgtccttcgcctgtaccgtgtttcaccagccgctgctgacgcttttaggcgcggatgcgaacacggcacaggctacggcggagtatttaaaatggaccgtgtctttcggcgcagcgcccgcgatcttgaatgtggttatggcatatctggtgagatcggagggcgcatcgctccatgccagtatcggaaccatgagcggatgtctgttaaatataatcctcgatcccatatttattctcccgtgggggctgaacatgggggcggccggagcggggcttgccacctttttatccaactgtgtggcctgcatctactttttcgtcctgctttacgtgcgcagatcgaatacctttatctgcatccttccgaagaatttccgcctgaagaaggcgattattctcggcgtgtgcggtgtgggaatcccggcggctatccagaacctgtttaatgtgacggggatgacgattatgaataatttcacctcttcctttggggccgatgcggtggcggccatgggaatcgctcagaaaatcaacatggtgccggtgcagatcgccctcggcttttcccagggcatcatgccgctggtcagctacagctatgccagcggaaacaggaagcggatgaaggaggcgatcctctttacggtgaagacgctgcttcctttcctgttctgcgtgtccgtgttctattatatcggggcgggcagcctgaccagggcatttatgaacaatgaggccattatcgcctatggaacgcggttcctgcgcggcttttgcctggcgcttccgtttctctgtatggatttcctggcagtcggtgtgtttcaggcggttggtatgggaaaagcggcgcttaccttcgccgtgctccgtaagattatcctggagattccggcactctatgtgctcaattacttattcccgctttacggcctgacgtacgcccagttcacggcggaatttgtgctggcaatcgcggccgtgtggatgctgacacgcatcttcagaagaatgcgggaaggcgaagcatcggtgggatagagtatggctgaaaaactatatccgctccgcctcagcgtttcgggcggtagatgatttcattgacggtgtaaaccgtgacaaatgcatttttatccgttttcatgatataggacatcagcatggcgtattcgtttttatcgacgatggtgatgatctcttttttcggctggttgtcgtaggctccgattgcctcatagatggtggcgccgctgtggagatggtggaggatgaagtccctgatttcttcctcgcgcttcgagataatgcacacccgtttctttaagttgaagccgaagatgaaatgatccagtgcgatcccgtttaaatacgttcccagcacgctcagcaccacgatcttcttatcgtagaccagggcggaggacagcgcgacgcacatgccggcaagggacatggcctttcccaagtccatgtgaaagtatttattcagaaattttgcaacgatatccaggccgccggatgacgcatttcggttaaatagcatggcgagtccgatgctgaccacgaagatgtagcagagcatgtccagaaacgcatcgtttgtaatcgattgattgtttgggaaaagcagttcaaacacacccagcattacaggaagcagaagcgaggtatagacggtctttgcgccgaattccctgccgataaacagaaatcccaggatcagaaggaagatatttaagacaagggtgatggccgatattttcagcggaataaagttgcccagaacgatggccagaccggagatgcttcctaccgacacgtggctggggatcagaaagaaaaacacggcagccgccacgatgacggtggcaaaggttataattaagaattcccggattgcttcccatttcttcatatggaacctccaataaaataagtgatattctccgcggcgcgtcatcggccgtgaggagttctgtctcgtattgtaacataaggaaaccgttcttgcgagagcaaaatgcagtaaaattataaaaacaggaggcaatcggcctcctgttttctattgctgcggcaattacaaaggtaccttcattttcttcttgacattttactaaggtacctttataatgtgaaaagaaggtaccttagtatttgactgttgaaaggaggaagtaccatgtcaacaataataatcggtctggttttatctgcaatggcggtctgttcgctgagactttctgccttgcgtctggcagggggctgcagcggcgggtccggtcagccgtacattcctaaagtgaaggttcgggatcgtaatcggttccattatccataccatacgagtttaaaagtatccgggatgtcgtccggcaacagcgccgtctgtgtggagaacgcgttaaacagcatggagggcgtatgggcaaaggtgaatctgctcaatgaaaaggtcagcgtttatatgaaacgggaggtggacgaggcggcgcttcggattgcactcaaggacgcgggctatgcagtcagcagggagacggaatatggagcggcggagctttgatcaaacgacgacagggtatgagaggagaaagacgatgaaacagaatgcgcacgaactgatggagcggttaatgcggatgcagtggctgctcaaccggtattttcaccggaatttaagagatcgcggcgttccctacagcgggcagggaagggtgctcaaggtattaaagatgaaaccggagattccccaaaaggagctgtcggagattctgggaatgaggcctcagtccattggggaactgctgtccaagctggagaagaagggctttatcacgcggacgccgtcaccgaatgataaacgcgtcataatcgttcacttgacggagaagggggccggcgcagaggagagcgagaacagccagcccggtcccgacgatatatttggctgcctttccgaggaagagcagagtacatttaaggagtatttagaccgcatgattgacgatctggaggaacgctgcggtgaaggcggagaacggagacggcgctgccgccggagtcaggaattctcctctgagtaccaggaagacgcagagggggctgactttgaccgaagacagaggcgcgaccggttctttcgcggctgacagtttattttgtagttaccattttactttccataccaatattgaacaggaggcagatgttcctatggcactgacgatgtcacgtgaaaattatttgaagattatttatatcctgaagaaggcgaacggggaggtccggtcgattgatattgcaaattatatggagctgtcaaaacccagtgtctgtgcggcggtgaagcagctgcaggcgcagggctacattacaaaggatgggaacgggatcatcgagcttacggagagcggcagagcggaggccaaagaggtgtttgagaggcactgcttcttcgaggaaaagctgattgccgtcggcgtttccccggagcaggcgcatgcagatgctgccagactggagcacgcggtcagcaatgagagctttcatgcgctgaaaaaggcaggcctgcccgcaggcagctaaatatgcacaatgagatataggagatatgcacaatgaaattaaaatagtgtcataccatggtttctgtgctatactggacatgtgtcaatttacttacgattattaggagatagctgcatgaagagagatgtcatacgaaagaacagtcaggacgctgagctctttcccttcgcgccgatccgcagacgctttctcatattctgcatcgtatgtgtcctggcggtcctgttcagcggcgcatgtcttacggtccgaaggatgaggcaatccgcagaggccgcgtatcaaagcgcttctgcacagatatcgcagaaggcaggggagtccataaagctgctgacttcactggcggcgctgccggaattttatgatccggacgtcccatgggagtcgaagacggcgaagcttgatgagatcaatcaatatttcggatatatgttcatctgctatgtggatgaggacatcgaggtctatactctgggagaggaagccgcgagcctggccagccgtgagtatatgcagacgctctattcgaccagggagattcaggtgacggatggcttcgtcgcaggggcagacggccggactttgaattacacggtcgcggtgcctctgattcaggatgacgtcatgaccggcagtctgttctgttccatctatttcgatgatgccgtcaatctgttaaagcagtccgcggcggccaacggggcggaggccgtgctgatcggttccaagggccagattatgtcgtccaccggaggcctggcgtttggcgcgtcctacacggagattcttcatgagtataagctgatcggactcacgacggacaagctggagacgcttctgctggcgagggattccggctctttccggagtctgaaggcggggaattcccgctataccgtgttcgggccgatcgagaatacgaactgggatattctggtgacagtcgatttcctgtcgctgttttctgcggagctgccatcccttctgctggctgcgctgtttcaaatactcattacactgattctgtatctgttcgttaaaaagcatattttcggtcagatggcgatcatggaaaatcttctgacctcgatacataagatggagaaaaagctgtacagcaatgcaatcgcaccggagagcgttgattatgaggatattctccagatgtccagcaaggggctgcgggatgaactcacaggtcttgcgaccaggacattcttcctgaatcagctggaaaaactgctgcgggacggaaattcttccggcaaactgtctctctgctttgtagatctggatgatttaaagctgctgaacgacacatacggccatgaggccggagattccgcgctgaagaagatcggctttatcctgcgcggatatgaaaagaaatatgagggcgttgtaggcaggtacggcggtgatgaatttattctgatccttaaggacatcgacagcgtggaagagctgaatgatgttttgagcgagcttgccgaacggctgcatttttccattaccgtaaacgggacggagatccctgtccactgcagcatgggagcgtgtgtctggaatcggaaggatacgttaaagaccctgatctcaaaggcggacaaggccctgtacgatgtgaaacgccatggaaaaggaacgtactcccttttcctgaatggagaataatactatgtttttcaaagacaaaagaaagtggattccattcggtatcctgattgtgtttgtgatcggtactgctgtgctggtacggagtgagattcagtctgcctccgttcagaaacggcagaaggaggcgcagacggcgctcagcttcttctatgaaaatctgtcggtaaactttgaaaagctcaattatgcgaagcagctgtcttataccgatccttaccttgacagggatctaacgctgtttgagcaggtatcgctgaggctgctggcggaatattccgccattgaggcgatcgcttactttgaaggagatacgctgacggcagtatatccgaaggaggaatacggggaagtcgtgggaaaagagcttcgggagttttcctacagctatactctggcaaaagtgataaaagacggcgtgatcgagggaccggagcagctgggagtcaaccaaaaggacgtatttctttttctttatcccatgattgtggaaaatgagtataagggagaaatcgcggcggccctcgaccgggactacgtgatctcacagatgggactcggttttctggaggaggccggctatgattatgagctgtggagagtcaattccatgggggagaataaaaacgtaatcgccgtatccgactcgtcgattgatttttccgatgcagtgaaatttacgttcagtcttccagccgtatggacgctcagcatcataccggagaatggctggttttctgtaaaacagcgtgtggccgttaatgtctgctgcggtgcggctgcgcttctcatcatagcgctggctatgcttgcgtggcggatcacggagcagaaacgggagctttacaaagctggctatacggagccggacagcggtctgtataccgtcgaaggcttctgcaattttgttgaccgccggattgggagaaggccgcagaccagcctctgcgtgctctatgtccggctgtccaatttccgcaggctgtccggggcggccagcagggaggaagtgcttgcctacctgggccgaatccgcgggagcatcggggagaatttccctgccggaacgctggctgcaaggctgggcgaggaggttattgcgatcgctctgtttgaagacagggagagtggggctgctgaggagatgatcgaggagtttgttctgcagctgttctggaagcggagcatgaatggtaaaaaggaattcgtgaatccagaatactgcacggtgtcctatccggcggacggttcccatgcggcagagcttctaaggcatgcggcggaacgttttgagagggaatttaaagagaaagaacagatggtgtgaagaggacatgcctgagaggaaaacacatgagaaaaaggactgacagatggagggcagcagtggcctgtatcgctctttgcggcgtgctgactgcctgtggacagaaggaaaaggtacaggacttaaaggaaacgggaatcacaaaggaaacgggaatcacagcggaagcgtcagagggtgaaaacggcggcggagaacctgagattaagatcgagaacgggagcaaagagcagcaggcagcaggaacccagggagcggattcttccggcaccggggagaatggatacaggatcatcagggaccagacgtttgaggcgaacttaaatcctttgggaaaggtgacatttgtctcctatgaaccggaggcaggggaaaattccaccgcagatgcacggttcgagctgaaggacggcggtcggactgtcgcggttctggacggcgtatataaggataataaccgtgaaaaggaacggttccaaaaggtggaggcggtgtccttcccagactataacagcgacggtttcaacgatattataatcatatgcagctatttaccgatgtccgggacagaggccggccgttccgaggtgagaatctacagcggaagtgaaagcggcgcatttaccctggaaaagggactgtcggaggcagccgattctgcacttgcagagaagacggttcaatccgtgctgggatttctgggagcgggaaagaagaatgaagcgccagccggatggaagcaggcgtacatcgattatcttcaggcccaggacggagaagagtgggttggatatcagctgatctatctcaatgatgacgacataccggagcttgtaaagatcggaaacagtgaggcggtgggctgtatgattgccgcctacgccggcggctctgtcgttgataaccagctgaaccggctgtatttcagttatattgagaagggaaaccttctctgcaattctgaggggaatatggacagctactatgacctggtatacaccatgacagacggtcagttatcgctggctgccagcggttactatggggcaaaggacaattcaaagcttgaattcgacaaaaacggggaggtggtctaccagtatgaatggaatggaacgctgatgtcccgtgaagaatacagccaggctctaaatgcagtctatgacacctcgaaggccagggacgggtatgcgtgggagcagtatctttccagggagcaggctattcagaaaatcagtgaaatgcagcagtgacattgcaaagatggaatgactatggtaaaatatagaaaaattctgtaagaaagagaggcgtcaatgatggataaaaacgtattggattatgttgttgagaagacgaacgatttaatgggtgcaccgtcatgcagcggcgaggcaaaggcagcggcccaggcctggctcgatgcggttggaacggacctggaagcggaagaaaccaggaagtatgtggaggaactggaagcggatattatgccgattgacggcctgatcggttttgcagaatccgagcacggtgctcaggtcttcggagcggataaggcgaaggcggttgcggctcatgcaagagagatcaaagcagccggagcaaagtactgtgattgtccggcctgtgcggccgcggaggcaattctggataagaaggatacacttctgggctaggagaaacgaagaaacggaatacttaacagggcatcggtcagcaatggccggtgccttttaccacatgaacaatacaggtttagaaagcgaattgtatggagcttaaattagaattagacagccggtcctgcggcgtgtctctcttccttccggatggaacgaaaccggataaaaaagccgtggatgagctgagaagtatgatgcagatggaacgtaccgtggagcgcatgaaggcggagggaggctttttttgagaatccggacagctcggtgagaagagccgctgtgacgccggattttcacaagggcgcaggcattcccatcggcacggtactgatgacggagggatttgtgattccccaggccatgggcaatgacattaactgcgggatgcggctgtataccacggatttgaaggaggaagaactggagcgcaggctgtcctccctgctgccggaggtccgccgtatcttctttgaaggcggccgcggcattgccatgaatggaattcagagggaagccatgctgaaagatggcctcactggcctgcttgagacatccggagaggcggcgggaaaaggaatctggaggctttacagccgggaggagcaggaaaaggaactggagtacaccgcatttcgcggaagtctgaaggccggagatacggaaggcttgggagattttaccggagatccccattccctgtcctacgatgatcagatcggttccataggaggcggaaatcatttcgtggaaatgcagcgcgtggcagagatctatgacgggcagaccgccaacgcctggggaatcaggaaaggcgcggtccttattatgatacataccggttctctgacgatcggccatcagagcggcaggatcaaccagatgataacgaagggactgtacccgaaaggcattccccatccggacaatgggatttaccttctgccggaaagaggcggaatggacagggaatggcgccgtttccgcgataccacccgcaatgccgctaattttggatttgccaaccggatgtttctggggctgatgcttcagaatgccgttgaaaatacggtgcgcgcctttgggatgaagcttctgtacgactcgccccataattttatctgggagagagaggcggaaggccggaagtattacattcacagaaagggcgcctgttcggccagaggcatggaagagatggagggaacccccttcgcctattacggggaaccggtgatgattcccggttccatgggaagctccagctatctcctcagaggcatggggaatccggatgcgctgtggagtgcaagccatggggcgggccgaaggctgtccagaggggaagcgatccatggcagcgatgaggaattccagaagtttatgaagaaatttcacgttgtaacgcccatcgatccaaacaggagtgatttgaaggggcggagcgatatcctgaagaaatgggaggaatccatacgttctgaggctccctacgcttataaggatatcgaccaggtggtgaaggtccatgaggaccacgatatggccgggctggtggcaagaatggagccgttgtttacggtaaaggcataaggattgtgaacagatttgacggcgaagtgatcagaagctacgaggtggaaagcacggccgatgagatttggattacagagagagtcaacaatctcttatttcagaagaagtgttaaagtgacagaagaaaaaacagatgaaaaaacagatgaaagaacagaagaaagacggcagaaagacattggaaaggtaatagacagatcatgataaacagagaagatatgctggaactgacaaggcgtatgacccttgcaagaacatccttcacgaggatcgcgggctgttatgtggacagggacggagattttgaggggagtttcaatacgaattttctgaaaatatccgcgccggagaggacgaaaaaactgaagctggcaaaggaaatccctttttctgcgacaaatgttaatctgaagaagtacgagtttccccagaacatgcgaaagccgggaagtatgtggcagctgcttatggccatgaatgagtgcggcttaaagaacgatgccctgatggacaccttttacgacctggtcatggaaaaataccataaaaatgcggcatacgcgattctggtctttcatgaccgctacgatatcccggcaaaggggagtgatggggaacggcagtgggagtcggaggaagtgtttgagtacatgatctgcgccatctgcccgatgaccggggagtatgagccgggaaaaccggaatgcggcttcctgtttccggcatttacggacaggagcggcgatcagaaccatattaatatcttccaggcggatgccgaccggcctcacagggagctgctggagctattagggttgggatgagggctggaactgccttttcagaacgatgttaaggagttggggaaactatgtggggcgtatgtctcgattttggaaccgtgcaggctggattgtttcagactgtcatacagtatgagatcaatgatgcagcaaactatgaaaatggaaaagtgaccattcttgcgcctgtgacgaatcttaccatagatgcagataagattaagcggttggaggaagcgccgggccatctgtacggagaaccggtttctcccaggaaccatccggaagtgactggcgttgtcgcaggtatctgctggcattttaatagaaactgttattattacaaaatagcggttgacggaaaaagaaaaagcaggcgttattttgagggtgatttgagagattagattagaaaagaccatattttcaggggattaagtagttcggagcatgagaaaagggatcgattgatgcagggaaaagcaggtatgataagtgcctgctttttatgactgcaaaagtgatgttagagaaaggccggaagcttaaaatatggaatggtatgagaaaatggaaaagtgtctttttgtcaatgatttcagccagtacctgctgaactttttagcggacagggcagaaattaccgggcaaagcaattctgaaaaatggaatctgttttttgaaaaggttgagggctggatgaatcaattctttatctcttcagagccggttgaactctacggagtgaacggctggtatgtggatctggaattcagccgcttccggcgcccggatggtacagaatttcagatggaggaatatgcggcggtcctgctgctcgcagacttggtgatttcccttgatggggatgcaatggaatacgaatgcttaaagaacactgaattcgagaagtattttcccgtgtattacgattatccggcagaagcgtgcgccgtactctctaatacgcaattctgcgatgaattacagaacttgtataaccgctcttttgaacggttccagtattatgtccatcagtcggtgagcaggaatccaaaagtgattgagaaattaaaaacacagtatccggtctttgctggctatatggcctatttcgagcaaaatttaaaggagagcaccaaaatagtccggttaaattcttttggaggcgaggaagaggtgtggtatatggtgcccgttgagtcttatgtatttctgatatccgtgggggaaatcatatgatgaaagtctggtaaatcttatcggtgagggaaaggctgtcatgcttagtctgaatgctcatttgttccattcagcacatcttgaattaaaatctctataaagcggtcaggttcttcccacagaggactgtgcgcagaattgtgaaatgtgtagaaccctttcagcggcgcatttacggcatcaaaatactttttctgcgtcggcaccgaacagcaaaagaagaactatatctgtttggttgcagacgagattatccgttatgcttttgatctgtaggtacctggacaggagtttcaggtagtttgttaaatagcaggccagggtgaagtgagatcaaacagattgcattttcatggtcatagtgttaaaatagaatataatgactgatacacatatggacactgtatttgtggaagagacgtttaactgggtaagaagaggatttatcgtgataaaaagatcgcgatgaccgccattgtgttcgcagatgaccggcagaagactgtggaatccggaatgaacagttggcgataccgattgatattccgcagttatatcagcccctggaccgatggctatagatggctctctaaaaacgcagcgcatgcctgctccagctgcatcagtcccggctcttctatgggaaaatgcccagcgccttccagtatgaccgtttgcttttcgcatgccagacgttgatagaagagaagactatactttaaatcagtccaatgatcttcggcgggatgaaccagaagaaagggacaggatttgaaatcttcgggttctgtttttaaaaccggattcagcatggtgtggatgaaggccagagataccctggctccggaagattttttgtctttcatcagaaccgcggcaagctcttcattgttgacaatcgctttcatattgccaatccatttcattggaattctgacatggcctgcaactctttgcagcagcaccagagcgggcttggcggccattcccacatagggattttttgcagaatgcttcgtgacttccttgtctctctgatcgagaatacaggaggccatcagaccgttaagctgggggcattccgtggctgtttgataggccagcatgccgcctgcgctgagtccgaataaaaatgtggagagttgtttcgtactttgatagtgatttacaatttcggttccgacggaaacccatgtctgccaggttacgttctttgaacagcgggtatacccatataatggcagatccggacagatcacttcgaatccatttttcattaagggcagcgcaagagcagagagcatgcgcccgtttccgccgactccatgaaagagtatgactcttccttttggggaagcaactttataatgatcaatatggatctccatagtgtctatggttaaataatattcttcgggcagttccgctttctccaatcgattatgaggcggcagatattcctgaacctttaaccaggtccggtcattttgatagctgtccattctgtttatctccttactgtttaaatgtcccacttgtggcatttatgattttatattataataagactatagtcaatgagggggagacatgttccccatatgacataaaatgtggcaggaaacacctatgaacatgaaaaaagagaatccccttacggttcagtcgaaacagtggatattagaagcgctgctgaaattaatggaagagaaagattatgagaagatcacaatcaaagagctgacggcccgtgcggatctggaccggaagaccttttaccggaatttccgttccaaagaagaggtgttatacttacagcttcaggaattgtgtgatctctatattcaaatgcttcaggatttgccgcagctttcagcctattccgtgacagaagcgtacttttcgctatgccggcagtacgctcattttttcatgctgctgaagcggaacaatcttctttttctggtgctgcagaaatttgacgagtatttgcctgcgatcaatgatctgtttctcagtaatcccgtgtataggggcaaatcaaagcaggagcttatctatcaggcaggcgggttctggaatatcacgattcactggataaacgatggaatggaagagagcccggaggagatggcggaggtgatcagcagtatcatgccgtcaccgtttaagtagatacaggatcgtaagaaacaggaggactcggccggaaaacggcgatggttgattccttctgtttttatttgatttgaacttacaagcgctataggaaccaagtgctgcatgtatcataatttccctaatattcattatacccatataatgaatatttctgtttaacataccgggaccctcgggcgtatttagtaatagccagcagaagtggtgatggcggcagtgattaaaaaagagttatagatagtgaaaaattatttccacgcatagttgaaaaccaatccaaaccatggtacgataaagagagcgattttcaactatgcgcgaaacacttcttgatcgcgaatagttgatagcagtagcagcaccaactattcgcggaataattaaacagtaagtttcagtaaatcaattagagcaatttcttcattcagctttttctttatggactccatagtctgcatttcagcttccagattcccaattttccgttccttaagaatatcatcatccgatccaccataataacggagattcttatccagtttatgagtcagggaatcaatacgggcaactacaacctggcggagatataaaagttcaagatcatctaatttcatagaaacacctcctcaaaagtaacacattttacatggcagcacgatcccgatcggagcggagccggcgcaagagtgtgttacattgcagacaagggccgatgggagagtacggcccatcgaccctgtttcgatcttcggagttcctgaggccgtcaagccacatttcattctgcgggcttgactgccgcccagtatactggctacgctatttgcacactgtccacgctaccgaatcggttaaaataaacttcgacattgtctcccaactggataccatcaacacggacacgctcaggcacatacaaacgctctacacgatcaccctgaattttcttgttatccggatcagtcggataagtacaatgcagattcgttcctcttactggctgaccagttttcttacttacataatccaccgtttcaattcctaatacatgataaaccatacaaacatcctccttaaaaaataatttatatacaaggcccaatcggaccatgttaccacttaaaacgtctttgcaaactcatatgccaacctcgattggatatcatgaaaaatattgcagtaaaccgatatcaattcaattaacccctgatccatacagaaatcattatagtaacggtacatcccaacaacagatgatataggtaaccgaaaaatataactatagcgaccacggacaaacgcttcaccaccatattctttcaaaatatcatccaacatagcccgataaaactccatttccttattttctttacacatacaaataacctccttaaacaaataaaataatatgaacttgtatcggggccctaaatctgctaaaatgtatatgcatgctcatttaagcggctctttttaggacccctgagaggaattccccatagaatatcatcgccatggtaactatggggctttttcctcttacttgtgtaacacattttacatacatccggattttggtgtatataatatgtggtacacttatacgataccattaaatatggcattagtcaataagatacattcaaatttaactttatatatacttataaatagcgaggtttaagaaatgcatctaataaataatataataaaaataatggaatcacaaaatataacagcatacaaactagaaaaagatacaggaataaaacaatccacattccaaggctggaaaagaggaagtgaaccatcagcagataaaatatatatattactgtcatatttgaatgttagcgcaaacgaactattcggttatgaccaagcccgtgatctactgaatgaaccgcaaaaagaaatggtatctatcatggaagacatggaagagagagaacaatggaaagctgtcggcatcatagagaactacagccaaaacataaaatctgaggtagaaaatgaatcggacgaatcatctatctcaaagatttcctagacttttaattcactggatgataaaatctaagaaaaggaggtatatcatgaataacgatgaaaaattagatttaatactttcagaaatgaaaaatatgagagacgatattacagatatcaaattaaccttagaaaatgttactaacaaaaatattcagattcttgcggaaggccatcaaataatcaatcataggcttgacgatgcaattaaagcagaaagcaatatagagatgacacgaataaaactcaacataatcgaagaagaaattaaaaaattaaaaaaagcagtaggaatataaaatcaggggccggaaaaatccagcccctttacgtaacacatgataacaccagctccgcgccgatcggttccacaatacataagaaattgtgttacatatccttttccctcaaaatagaaatacgatattctgcaatattacaaattctgtttcgggcagaatgcttcatctcacatacctcaaatatatcatctgaattaagcattttagcaatatcctcaatcagcattgttatttctttccgataatcctcattagtcatttccaacatctcattgtcacacattttttaagaaattccttcccggccagaaacacctggagattttttggtattacacaattcctcaatctgacctatcgtatctgccatatccgacagtctgtttttcatagattgtaattcctcaatcataccatttatcacatccagacgcttatgtaatccaagccattcacgacgttcatcatcagcacatctcttgtaatattcataatcctttttcgaatcctccagagcatcaaaacagaagagtaccaaattctcaaatttagcattcatggaatcccctgcaaagccttccagaatctcagcaacacgatcagaatatcgaaagctacgtaaattattcttattttctttcttcataaaaaaatacctccttaaaattgtaatacactttagcaactgcagcacgccgatcagctccggagcaggccggacactgtgttacagttattcgggaaacggcagtttacaatcaaaatccgttataaaatcagtaccttccgtgttgacaggctcttccgcagagcttataataaacttgtcaaacaaacaattaactaaacaatctaaaatgttactatcaacccggagccgtatccctgaacaaagatacggttctattttttttcgtgtccggaagttaatccgttgcgcgtaactttccatatcgccccctagagcttctatttcctgtaacatgtccagatatagccttgcctgcgcaggaagtgcttcacggccattttgaaggtctacaggggcacggattaagatatcatcaaacactggtatattatcactgcaaaaagtatactcaatacgtgttaactcgtaatccagatgctgttcaacctgcttatcataaatcttacaatacccatgcttatgacgctgaccaaaatatcttgtacccttataaagacctttttcttttctgcttccaaggactacaacatcacttaaaggacattttatatccacggcataatcatatcttactaaataaccatctttacaattattacggatataccggatcactgcttccataagcggcgtgccgtcatgcttattaggattcactttaaaacgcatcacatccagttccaaccatgaaccatgaactttatcataatgactgtattttccaagactaaatgtgaatccgtcataccagattaagttccggtaatactcataccggaatgacgggagcatatccaatttagaaccggaatcctgaataaacccaaatggcgccaatacgtcaaaaagaagagtagtcgccagtttataaggacaggtcaaataataatccacgatgatattatcaatcgaatgagtaaacccataggaatctacatactcattttgatacgtaaaaccaccacctttattgtatctgaatttcaaacaattcaatcaccaattcttacgaaattcttacatcattgtatttatacaatgaaatcccgttattaagtagcgggatttcattttcagataatttccggcaggaggtcggccgtgccaagctacggccgctcacctgcctttctgaacaatccgaagaatgcctttagtaattcgaagaccttgaacagacctaagaacatgagtatatagattaccaactccatagcttaacctctctttcaaattaggataattaggaacagggcagtaagaaaattccttttccggaagctccggaatatcaaaactatcaaagtactttatccacctgggtatataagtgatctggatagaaccacaccagaagaacagcagggaatcgaactgcatatcatccgccagatgagattccccggtaccagaatcgctatgcacaatcgtaatacacttattaatgcgtctggccacggagagaaaattaaaatgagaccggattaagtacatggaatcagtcagatcacgcagtttcttatcaatatcaaaagactggctaaacagataaaccgtatgatgataatgacgctggagcttaaaataatttctatactcctttttaaaccctttaaaatcccggctgtcccataccattccaacttcatcaataagaattacagactcagaaggaatagaataaaatccgatatcctcaggattaaaataataagcccccggaataggaaccgtagaataaaccggacgccctttcttcagatactttaaacaagtttttgtaagatacgttgtctttccagatcccttcttaccaaaaaccataatcagcttatatggattacgataccggataaactggataataaaaaagatcatgataaaacccagtatcaaaaaaatcaggaacgccatcgcatcaccccccttaaaactttaaaaacaagaccaacaatcaaacagacaacaaagagcaggagaggagcggttattataagagaatccattgataaatgaaaaaacggatataaagcaaaatcaaaaagaaattccataaaagcaatcataagccacctctattgtacacaggagagaaacggagcttccccgatcggggaagctcacatctcgatattgtgttacacactatgaaagatacggacgaacaggctgataataaaaccgacaaagaagaggccgacaaccgccattacaagaggcgtactgacaataaaagcaaccacacttgtcataccagatattgcccatgtaagcatacttgtaaaatctccggtaataccagacatccccccggattcactggcataagcaggcatagtaaataaaacagccatcatcatagccaacccggaagaaccatacttcttacacctcgaatacaaccgaaccatcatgttacgcatagaaattacctccttaataaatttttctaaatatattgataagctttctaagaagcattatcccaatcactgagattccgataatattagcagtccagaacccattccaaagggcggtaaacgacttaaaaataagatctgacaattgtttgaacgcatccataactacctccttaaaaaatgacctaacagaattttaaaaacagaatagaaacagtctgtcaggtaaagaagcaccagaattaaaataatataaaccactggttcaaacccatatggtatatcacctatgagcttgacgacctcttccataagcacagccatacacctccaatcaaaaatatagtaactaacatgatgcagtacattttataatcaaatgaatccgattcataaaccgttacatccgttacctgataaagaccgtatatattctcattagcaaggcttgaagaagaggaagagcggtaatagcgcgtccggtaagagggatatccataacggtaaatatcactcgatgtatttgtcagtacagaccggagtgtaaaaaggttatactcataatctgaactatcgaattgatctgtataaaacaacctgccaaccagattaccgcttccgacattaaacaaatagccggaatcatcaatccataaagaagcctgcaaagataaaggaaacactaatttacaggactgaccgccaaataccccatcatatacaaccacgttacggtcaggaagattaccaacagcataagaatcagaatccgcaataagcgaaaaaacttccgtatcttccatttcatacgccgcatcggacggggaagcaagtaacggaccggataataaatcacgtatctcagccacgaccgcataaagttctgaattcgaaacatactcatcctccgttaaatcatacatatgatcattgtcatcatgaacagacaaatcagcatcggcaggagtagcgacagatgcataagcagataccggatggcagatacaccaaggcaataccagtagagccaaaatacgtaaaaggcaagggctataaagagtatatttattttccacatcataacctctcttttctaaatctgataataagtgaaccgaccaatacagccattacggatactccaatataaaacgaaccaagactaatattctgaaggagtgaaacagaaagaacccagtcaacaaatttaccaatcagccaaacagtataatcaaaaaaatcctgcatattattcccccttattgataagtgttacgatcacagcaatggcaataaaaataacaataaacgttgatagaaacgcaggcagataaccaaacacagcagtaagataagcaagtgctttcggtatttgtgtaatcagcaaaatcagcattttaaaagcattaataacaaaattaataaccaaagcaataacttccacgatggaatcaaagaacttgaacaatccaaaacctccttacatgtaacacataatagcgacagctccggagcaggccaaagagccggcagacaaaaaatgtattacaattaagctttataccgcgcataaccgatcagcatcagacagataacaagagtgagagagagtataatcggaaaattaaaagcccccatgctttcaaaaacagattgcatataatttcctacgaacataacagaagaaaggacaccaacagccattcctgattccggagttccaaaatcaaagtcagcaagagcagaattaacagtatctgtaatactatcctcaacattctggtattcgtcaaaagtggaagagagcgattcagaagtagaatccatttttgaagaatcccaatcattctttaaagaatccatattcttatcgttattttgagttattttatctgtgtttttatcgttattctgagttactttatctgtatttttatcattgttctgggtaatcttattagtattctgatcattattttgtgttatcttatcagcatttttatccgcatttccagtaattgagttaccgagattagttaatccggaagaaatactattctgcaaattcgttatagtattagtgattgtgttcatgatcgtagtggtagaagtagtaatctgattactgatattactcacagtgttactgatattcgttactacatttttgatgatagttgtattagcggcagtagtctgcccctgagaccctgaatcagactttggtatataactcgaagaaacagaatatacaccaatattctgactaaaatacggatcactaccagtagacttacaaagcaacgcaaatcgcatatcagatgcaagcaaatcataaggaggcgtaaacgtcagtatagctttaccagcataagacgataaggaagccccccaaagattaggaaatgtaccgaggaatgtagactgatcatacaaatcaatcccattcaggacataaggtacattaaacacaatggaatattcataccccttataaaaccatacattagacaaagtgggcatttgcacaaaaatccaggcattaggaagatggcccatatagataccaccataaggaacttttgaattattaccaacatattgataataaagctttggatgagtagaagtatcccccacatacaaaccattcaattcctcgtatacattacctgtataaacaaaggtagttaccgaaaaagctgaatggccagatttaagttcaaaattaaaaacataccttgaaccagcaatagcatgaatcggaaaatagaaactataagcaagatcattcggaagcttcacataatatttactaaaatctgaaatcgttttagacgaccatgttccattagactgatattcttctaaaataagagatttaacatcacttaatttaagtcccattatctgcacttccataccattaggagtaccagaatttaatgtaacatacttaagataccgttgagcagtagcaggaacactaggattagtccccatagtgatatatttaccagtagaatcaacatattgatttacctgagtaagatcaagatcagaagcagccaacgccataggctgcattaataattgatccgtataataatcagcatccggctgcaccgcatccgaagccgtagccagatcatcagcaaatacagggaacacaaaagacacggccagagcaacagccagaacaagagagtagacagattttcgattcataaaaggccccctcaaaaattaatagcgaacagttgaaaaagccttaaaaccatggtacgataaagagagcgatttccaactatgcgcgaaacacttctttaacgaatagttagcgctaaaaagcgccattttacatcaattacataaaggagccattttacatgaaacttcaacggctatacagtctcacccgccaggctatcgaccactaccatctgattgaggacggcgaccatatcgctgtcggtatatccggcggtaaagacagcctcactttattatatgccttacagggattaaaacaattttatccgaagcaatttgaattatccgctattacagtagatttgggctttggagaatttgacttatctcctgtcaaagaactctgtgagcgattttcagttccttatacgatagtttctacggaaatcggaaaaatattgttcgacacacgcgaggaatccaatccgtgcgccctctgtgcaaagcttcgcaaaggcgctttaaatgaagcggccataaaactgggctgtaataaaattgcttatgcgcatcatcgtgaggacctgatcgaaaccatgttattatcattaatttatgaaggccggttttacgcattttctcccagtacgtatttggaccgtaccggattaacggtgattcgcccgatgatttacgttaaggaagccgatgtaattggctttaagaacaaatacgatttaccggtatgtaaaaatccgtgtcctgtggacggccatacaaaacgggaatatgttaaaaatttaacgaaaacactggaacgggaaaatccgggtgtaaaagatcgtcttttccatgcgattgtcgatggaaatattgaaggctggccggaaattctcagcaaacccacaacggaagttataaaaagtcatgaataaatcatgaaggaatcatgaacgaatcaggaggcatcaattatgagtacactctcctaccatcagcagagagatattgagaatgtaaaacatttaagggaactgatccgggaacttccgcccttctgcgccgatttctttcgtggaatcgagccgcgcacctcctctaggaccagaattgcctatgcgtatgatttaaaagtattcttcgatttccttttaaaggaaaaccctgtgattgcgaaaatggatatgaaagacatcagtctggaccatctcgacaatttaaagcttgtggacatggaagaatatatggagtatttgaaataccgttttaacgataaaaatcaggaagtcaccaataaagaacgcggaatcatgcgaaaaatttcttcgctgaagagcttctataattattattaccggaatgaacgccttgtaaacaacccggcggctctggtacagcttcccaagcttcacgaaaaagagattattcgtctcgacgtggacgaagtcgctcttctgctggacgaggtagaaaagggagatgcgctcacggagaaacagaaaagctatcacgataagacgaagctgcgcgacctggctctgctgacgctgatgctggggactggtattcgtgtgtcggagtgcgttggcctggatattgatgatatagactttaaaaatggcggaatccgcattcacagaaaaggcggaaaggaagtaactgtttatttcggctctgaggttgaagacgcccttaacgattatctggaagaacggaaaatgatcattgccgaggaaggccacgaatcggccctgtttctctctctccagagaaagagactcgccgtgcgcagtgtggaaaatctggtaaaaaaatacgcgcggatcgtgacccctttaaagaaaattacgccgcataagctgcgcagcacctatggaaccaatctgtataaagagacaaatgacatctatctggtcgcagatgtgctgggacacgccgacgtcaatacgacgaaaaagcattacgcggctcttgaagatgaacgccggcgcagtgcgcggaataaagtacggcttcgtgaggactgagatgtcctttatttaaaagaatcgattgaaaagtgggtagagattagacactctgcccacttttcgtatgtcactgtcccgcagtatttttgacaaattccctgactgcatgcagctgcttttcacttaagtcaaaataccctttgctcccaaacgcggcatgattcgtaagaaacacttttacaggcagtggtttctcacatacgcatatccccttttcttttgcaagcgcgccgatcttacgagcgccatccattccgccggcagtcgagaacgccgcaatggattttaccagattggaatccaacgttctcaaatacgctttcaaatcaggatcgatgtcccatttatataccccgccgcccacatacaacagatcgacgggttcctctagcggaacatcgatggcctgcgctctgacgcctgcgattttgccaatagcttctgcgacggtcttggtattgcctccgcgtgattggtaccgtatcgcgattttcataatccgcctgtccttttacgagtgtctgcaggccatacgcaatcccgcgtaaaattccatggccagatgcagggaatggccgctcacaatttcatccggcgtattttcaggccagtaaacggccagcttggcctcaaacccatccgctgcaggcttaaactgatgatagggagtattgatttcagtcaccccatccgttagataggcacgcccagccatagatacaggataatccgggtctctgtctgcccgaatttgctgccccagctcggaaatgtcaaccacccgtacgttgcacagcgtcggggttccatacatgccaaagggttcaatgccgcagagtttcccgtcgtcaaacgctacattgcagataaagtgctccgggtgcgcggagaggccgacgcggtcatcgtcctgcatagaacgcatcatcatcataaactcctgtaaggaaacgccgctgactgacatattacagcgtgaaaccctcataggcttgtcctgggaaaatgcaagctcacgccacattgcatcggactttgccagagagtcctgatacagttcaatgattttatcgccggtatactgtatgcgggtattaatcgaaatctcccacgcttttccggttgtgagatggtcgatctcgtcgtcggtcagagtcgcctccccctccttgatttccacgccatggcgtttcatctggtgcagaacatggaggttccgctcatattccagccgttccagatgacttcttttccatacctcaccgttgacggtgaaggtgtaattcatttgagacataaaatttcctccttgtgatggttgatattatggtgatgattgtattgtgcaacaacgtgttgtgtgatatattatcagatatacagcttttcagtcaacaacactataccagggagatgtcggattgttatgaacaaacagccggaaattacagatagaacgaggcagacttttatggaggcgttttgcctgttatatagccaaaagccccttgaaaagataactgttcaggaaattgcaaggaaagccggattcaatcgaagtacattttatcagtactttttagatgttaatgatttgctctgcgatgtcgaaaatgaatttttaaagtatatttctgataaacgcgggcaggctggagccagcagcacgccctttatcgaagacattgtggtgctgtatgaaacaaagtccatctacatcaatgctctgtttggcagatatggcagcaatcagtttttagaacgattaaaggcagcggttaagctggagatgccggagcttgaccggtcgacgaatgacaggctaaaaccgtatttgatggaataccgtttctctggtgcgttgtcgttgtttcgcttctggctaagcaggggaaaagacctctccacacaagaatttttgactttgatagcgagcctgtatgagcatggagcatcctccatcagttttattgaaaatggagaaaaagaatcacagtaataatcaggccgcagcggaatatccccctgtggcctgatacttatacaaccgtagctgcataccccttctgcatttttcctttttcaacacactgtatcaccccatctacgtagaagggaatattatcttcgctcaaaaggagtaatcgaatgtccccctgtctgaaaaattcacagcaaaactgtctgcagtactgatcatatcatcatataaacgattcatattcacacccttccgaatatcactgtaactataccatccagcctccgccatttccatactttttcacattttccctgtatatgataaaaaacacttgacagaatgatgcgaagccattatgatcaagctaggtaatttcaggaacaacagaaagaaaattatagaaatcagaggtctgagagattgtttattagattaagatagtaaagactgttcgttataagagatcatgtataaattccatggcggcacggtaccgtatccattcgcaggtacgcttgttttgtatggtttatttatatatgtttataaccggaacagtttttttgtgtcttagtctgccgatccggcatggatacaatctctttttttgtacctgaaattaccaatatcacgattaggaggtacgcgatgatgtcaggaatgatatgcttttttattcggttacgattcaaatgtgtgaataacaggatgataacccgtttataatcaggcggttacagccgcgtactgcacagagccaaatcgatccggctcgctgcccgcggaaataaatttgccgcctgaagctgcgccgcgcccctctcctttccaggacggtgagaaatgggaacggcagcaaggaggctgaacaatatatgaaacaacagaatgaaaccataagaccccgcgctctgctggctggggtacatttaaacgaaaacaatgattttgaagtatccatgaaagaactgcacaatctggtgaaggcctgcgatatggatccggtggtcagagtcgatcagaatctctcctgtattaacgccgcttactatatcggctcgggaaaggttggcgagatcagggaagccgtggagacgctctacgtggactatgtcattttcaacgataccttatctccctcccagcttaaaaatctgcagagggagatcgatgtgccggtatgggaccggacctacctgattctggagatattttcacggagagcccggactaaagaggctaaaatgcaggtggaatcggccagacttcagtatatgctgccgagacttatgggactcagagactctctggggcgccagggcggagccagcggttccttgagcaacaagggatccggtgaaaagcagattgagctggaccggcgaaaaatcgaggggcgtatcagcgaactgaggcgcgaactggaacggatggagcaggaacgcgaagtccagagaagaaaacggacccagggaacgtatccgcaggccgcgctggtcggatataccaacgcaggcaaatccacgctgctgaacaaactggtggaactgtcgagcggaaaagaggaaaagatggttatggcgaaggatatgctgtttgccacgctggacaccaccgttcgaaagatatccctgagcggcagccaggatttcctgctctccgatacggtcggttttatcagccgccttccccacagcctggtcaaggcgttccgctccacgctggatgagatacgttatgcggatcttctgcttcatgtagtggatttttcggatgagcattacaaagaacagatagaggtaacagaggaaacgctgaaagaactgggggccggtgatattccaaggatctatattatgaacaaggccgattccgttatggaggaggaaacgctccctaaaatttcggataaccggatctatatgtcggcgaaatacggcatcggtatcccggagctgatgcgtatgatggagaagattctcttttctgaataccaggaggcccagttcctgatcccttatgagaacggtaatgtggtccactacttaaacagccgcgccatggttcacagccgggaatttcaggaaaatggagtctgcctgacagtcagctgccgggaaggcgacagggagaaatataagcagtatttgacgagataagataagagtaccaatgaataaaagtacctgatgcgcagaaaccgtgtaaccggtctgcggtatcaggtactttttttacatggctcaatctgttttctttcactaaatcacggagtttctgatatgtatctttgtcagcctctcgatctgctgcataatctccggaattcgaagcttatggggacactgcttcatgcaggacatactggtacagcttctgcaggccgccgcgctctcttctattcccagatcgagctttctgagggcccagtaatcctttcccagaaaaaagtagtgatactgccggaaaaccgtatgaatttccgttccatgcgggcaggtacaccgctggcacctgtcgcaggaaatcggctcgtaacgcttccccaggacggtgagcaccctttgaaaatcggggcgttccgggaccgtatccccggctgcggctgcgtttacctcttccactgtccctagtccgatcagggcgcaggaaaccggataagtaagaaccccttcaatcagtgtctttacagggaaaaaggaaggcagaatcccggcggcgtaaaccttattaaccagaaatcccttttgcctgaaaagcggctctctttcgatgcgttccagcatgccgcgttccagaatgttgccgcttccctgcagcacatcgatccggtcatcctttgctcctcttaagaggatgtcgtagtaatgggaggcaatgcctgtgaagcgaattttcccctcagccttcagttcagccagagcatcagcggcgccgtaccggccaaagacctgatcttcgtgatctgaatccacctgatgggaaaaatagatgtccggtgcggttcccaggttcttagtcgattcaagaacagcctgatacatctcattgccggtatagaaccgggctttatcagagatgacgatcttatcgcggccgatttttttcgcaaatgctcccagtttcagttcggcgtctccatattccgggacaatggccgtatcgtacaaattgcatccgagtctccaggcgtgctccatgacggcgacagccccttctgtatcagggctgtagtagcctggaagaaccgggacattgccgcttaatatgggaatggttccaaaaccgatctccgatacgcgcagaccggtagttccgagatctctgtatttcatggcatcaccctttctgcctcatgattacggcaccaggcaaacgccctttccccaacctgttcgatcccctccggcagcgtgatatccgtcaggttatagcagaatgcgaatgcctctttcccgattctcttcagtgtagacgggagcaccacccgtttcagctcatggcaccggtaaaaggttcctggaagaatctcctcaatgccttccggcaaaatgatttcctccagtgaggtgcagttttcaaatgcgcgctctcccagagactggagcatgggcagttcttcgatccgtttcaaacggacgcagccggaaaaagccatgcggccgatacgggtgaggcgggaggtgccgctcaccgtttccagccatttacactgttcaaatgcgcactcaccgactgctgcggcagagtccggcagcgtgatgctggtgagaaggttgctgtcctttaacgcaccgcgcccgatttccgtgattccctccggcagaattaagcggcttatatttcccgtacattccagcagcagtcccgttccgtctgtcttgaagcagttacagcagtcctcgaaaatctgtcttaccatggatggaagctcctgatccagcgaaggaaggccctccaggcagtactctctcccatcggctgtaacaatgcgtttcagccggatacagtttcgaaacgcatgtatctccaccactgtccgggaggaagaaaatctgattccggttaaatcgatgcagttggcaaaggcccaccctgaaacccgtttgacgatagggctgattaccacgtcgccggagcaggcggccgcgtcaatgattatatttttaacggtaacaggatctgttccgctgacggcgcgcagctgttccagccagggggtcttgtcaaatgcccgcggaccgatatactccacggaatccgggattgagactgcctcaagccgtgcctgatccttaaacacctcttccccgatggttttcacgccttcgggtatggccacaaaccggccgcagttcctgtattcggttaatgcgaactcttcatcgatggtaaaacagctcaaggcacttccatagatgcgcctgacggcctccggcagcttccggtcaaacagagtctcatatcccgtaagctgatacactgtgttctccagaataaccctgcgcatggcggtacaaccggaaaatgcatagctggccggaaaatccatgttctgtccgtcacgcagtaggatttcctccagatgtccacagtcctcaaagctgtgatcggacaaggcggacaacgtgggaagcagcatgctttttaatacgtcacagcgctcaaatgcccgtgtaccgatccgttcggccagagggaagtgaaccgcctccagacttttgcagcagctgaaggcttctctccccatgcggcggagattttccatgcggcatatttttaaagccgaacagccgcagaacgcgccgtcccccaggagaaccgtctcctctaacgtgactgattcaagactttgacaccaggcaaatgctctggcgccgatttctgtaatccggcaggagaaagcggtcagggagatacatttttcgaaggcggaactgcccatctcctcaagcggggctgaaacatgaaccgactttaaattccggcatcctgcaaaggaagagctgccaattctttttaagcttactggaaaatagagcgaccggaggcggtcatttccggcaaaggcgtagtccgcgatcccggcaacgccttccggaatggtcacgtcaccgcttaagcctgagccgtcaatcagaataccggagacgatggcggctccgggaagcggaccgtttcccatccgcttctgctcctccagaaatggtgtaccggaaaatgccgagtctccgatctgaagaaataccccctcaatccttcttaacttttcacaaccggaaaacgcactggttcccaccacagtacagcgttccagagaaggaacctctgtcagttcccgacagtttaaaaatgcgcgggccgacaccgaagtcagctgaccgtcaggctgtgctgctgaaaccgtctgtaaggccgtgcagcgggcgaaaacgccttcctcgaggattttaacgccaggagggagaaggacctctgtgagcccggtacagccgcaaaacgcatatggcccaatctgcgacagcgtcttcggtagggtgatggaggtgagctccgtgttcccgtaaaaagcgcctcccgcaatggcccgaacctcatctccgagaacgccgccgccggagaatccgctgccgtccaacaatatgtgacggaccgttttatcggctggaagctcctttagaaagcggctgccttcaaatgcgtgttttccaatggcttcgatcgaatccggcagtatgacggcggcgagcttctcacactggaatgcaaatttatctccgacataccgtaccccgtcttcaaatgtgagccgtctcatcttcccgcactgggaaaatacgtcggttccgcaggaaaacggattgcagaatacctgggcatttcgaatcccggaatgggtaaatacgttgcgcccgatcaccttcagggaaggcggcagcacgatatcccgcagggagaggcaccggtaaaaggccatgtcgcccagaacggtcactgtctccggcagcacaatgtcttttaatttttcacatccgtagaaggccagctctccgatctcttcgagcctggcggagaaacgcacttcgtttaatacacggcaccggttaaatacggatggacagatgcttataagagaatccggaaggatggcccgaatcagttttacgcagttttcaaaggcggattttccaatatgtctgactccctccggaaactggatggtctgcaggacgagacagtctgcgaatgcttcctccccgatcatctccaccgaatccggaaggatgacccggtcgatggcttcattgcctgcaaaggcccgctcgccgatcacggtaattccatcgggaacgacgacccgttcctcgcttccgcgataccgaagcagcgtggtcccgctgatggagaaattccccaggacctgggcgtggatttcccggactatggacggagcgcccgtttcatcctggccgcttaagccggtaagctcgtattcacttccatccgccaggcggatggtatgaagcgtggagcagttcttaaacgcgtctttgtgaatggccacccggccgctggcaaattccacccgttccaggttgatgcagtttcggaaggcgcggctcccgatttctgtgagactggcgggaagccttacggaaatgattccttttttatcaaagaagcagcttttcccgatcgcggtaattccctcggcaagttccacgtgttttaaattcgtgagaaaacgggtgatgacgccatcctgtatctccatcatccggcagatatcggcggcaatggcgcggaccgtctcgggagcgtcagaaccgggtgccatggcggcgacggcattggccatgtgataggaggtcccgtcggaaaacgcgatatccagaagaccgctgcatccggtaaaacagtcacagatatgttgaatatcaagctccggagagatcaggatgcgtcggagcctgatatcatttaaaaatgtctgaaggcccagagactgaacaccgggcatatttacggtctccaggctgtcacagtaaagaaagacgcagttgccaagcgccttgacggaggcagggatcgtgatggccgtaaggctgtggcagcggtgaaatgcgtaattgccgatggtgtccagcctgtccggcagcgtgatttccgtcagcttccgacagcccttaaaggcgtcatcagagatgaccgtgactgtatccggaagaagaatctgctccagggaggtacagcccttaaacgccccttttccaatggtgtgaacgccactggggacggcaacggaacggttccgtgtctcgcattgttccagaattccgttttttatgaccaggccgtcattgttattcagttctgagcctgcgctgctgctgtttgggatatttgtatctgttccattcatctccggtccgcctcctcctcatagaatattgcttttaatatctgtttcatttcttccacattgccgcagtgatagagaagctgcttgtattttttcgttccgctcctcttcttcatgcagtaggatgccagcttcttcatataggtcagcgtgtaggtctcatcataatggcgggaggtcagttccagctggcccattaaaaggctgtatttgtcttcggtaacactgcggccggtaagacggctgaaaatgtacggatcctggagggcgtaacggccgatcatcactccatctgcgccggtggcctccagcatgtgctgcgcttcgctgtcggaaaagattccgccgttggcgatgacagggatggatacggcggattttgcctgttcgatctgatcgtaatacggagtgccgtcatacatcatgctgcggctcctcccgtggatagagaccatgtcagcgccggcttcctcacacatcttcgtgaattccgcggcaatcagctcgtcctgccggatgccgacgcgcgtttttacggttaccggttttccgctttttttacagccgcggatgacagcggccgcccgtctgggattggccagaagcgcgctgccctctccgctcttaaagatattcggtaccggacatcccatattgatatcgatgatatcgaagccggacagagcctcgctgcaggcggcccgttccatcaccgcaggatcggagccaagaagctgcacggcccggatccgttcttctctggtggtgtacaaaagcttttctgtggctttatctttatatttcagcgcgttggcgctgaccatttccgtaaaacagaggccggctcccagctcctgacacagcattcgaaagggccaggaggtgtagccggccaggggcgccatcagcacattggaagggagaagcagatggttaagccttaaaggatttgtgttcatactaattactccataggtgttgtcagttccttttattttaccgtaaaagagccgttacggcaatgaaaattaaaacggtggataaaggaagggagaactctgttcttcccctctctttatccaccgcagaattaatccatggtgacgagatcgatggacgccggattgacgaatatgcgtatgcgctccacggaaaccgtgtcgtaagagccgatctgccgattctttatatcttccagaagctgatccttacctgccataaagagctccatatcatcaagaagataatcgaactcgattcctacatacgggtcatccgattccttatccgagtatcgcagataaggggcaaccgcttttacattataggtgatctgaaaacgaatggtgttctccggaacggtctcatccggtaagatctctgtggaatcagccgagtgtctgtgaaaatagtaattaccgtatattctcagcttctgctcttcctgaagctgaaaggagtagtcgagattctcagttgtcatcttcacatcgccaatcatggtcctgccggaataggcgaaagatgaaaattcggagaaggaaattccggtgccgattccggtaatgaatactccgctgcagaaaactgcgatcagcgctttatgtaagttacgcatcctgtacctcctctgtgagtggaacggcggtttcttccgccttataacgattcgttttattcatgcgaagcaggcttacgcagaaaaaggtaaatgcaccgctgcaaagcacggtgccgaacagaaccagggtaatccctgtcaggggatatcccttaaacagccatacgatcagaatgccgaaacagaacagtgatcccagcacgaacagaccgccaaacagggccagaaacatcataaacagattccagcaccacttaaggccccacaggcagaggcgaatgattccgtgaaagcagcttccaatggcgaaggcgatggaatggcccagcgtgtgcatggcggggactgcccttccagagacgccggcggatgttctactgtgttctctcttttttctttccgtatcaatggtcacggtctttttctctctgtgcagcagcgagcgaatctttcgtatgggacagaggatcagataagccgccttttttcctatggcctttcccgcttcatagcagcagacagcgccgtggcgtgctgcggcagacagcttcttaaaaaagcgggcaaacttatcacgcaggtcggccccgtgaaccgtgatcggctttaccgggagcttccggccgtccttcgccgcatcaccggaaaattccgctttgacgtggtaagcctccagaatctgggcggccagctccttaacacttccaaaatcgcggatggcctcgtcctcacttaatccgctctccaccttcatatcaatatgctgggagtactcctccaaaatatcctgctgttcctcatcttcaaggataaggaggtgccggtttaactcttccaaaaattcattcttattcatccttctgctccttcaaaaatgtacatacccgctgttgaaattcgttccactcctgctccagtgtctcccggtagagaactccggcagcagtcaagtggtaatacttccgcggcggcccctctgtggattcccgcagatatgtctcaaaatagtgctcattggtcagccgcttcagcagcggataaatggttccctcattcacatcgatgaccttggatacctcttccaccagctcgtacccatacatatccttcttcctcacggactccagcaccaccagttcaaggactccttttttaaactgtgcattcattttaagtcctcctttaatactatattatacatactactatgtaatgtcaagtactaattaaaataaaatactgaaagtgcacgaaatgtatttataattctgaatccgatcgggtcacatgcatcaaaaaaacaccggcctcgcatgacccgattacagatcatggaagccggtgctgcctatattgatagaggaatggaggatatggccagaaagatacggctctctgccctttgccctcttctactcttcgctgtttttgtctatgttctgctttctttttcctcaatgaatctctggatttgtctcttcatgttctctgcctctgattctctgtccctatttttctgccagaacctcagtaacaggcacacagtacatgatggtcaaatgctggccgctgtggatcacatcctccttcagcccgttcatactcttcaactcagcgacgtaatcggtggtggacatgcggcagctctcggcatattcatcggcgattccccagagtgtatcgcctttctgaatcttgatgctggtataatacttttgagactccggaagttctgtttcatcggccagtgcattcatcagagaatgaccgcagacgttcgacagaatcaaaacaacaagtgccatcgtaatcattaattttttcatctgtatttaccccctgtaactcttttgtgacaaaaagaacatttgttctgtatgggtatatcataccactcgaacaaatgtttgtcaagaaagaaagccacttttttcgaacaaaggtttgcatttttatcgaacatatgttactataaaagaaagaaaaaggattgaggaggctgtgttatatggctcaggagaagataacagcgaaacagcaggaaattttagaatatatcaaagaaacgatcttaaaaaaggggtatccgccggctgtccgggagatctgtgaagcggtacatttaaagtcaacctcttccgtccactcccatttagagacactggaggaaaagggatacataagaagggaccccaccaagccgagaacgattgagattatcgacgactgctttaatttgacgagacgcgaggttgtgaacgtgccgctcgttggtaccgtggccgccggtgttccgcttctggctgaagagaacattgagaattattatcccatccccgtggagcttctcccgaatgcggagacctttatgctgaatgtaaagggaaacagtatgattaatgccggtatctacgatggagatcagctgattgtggaaaggtgctccaccgcttacgacggagagatcgttgtggcgctggttgatgattcggctacagtaaagcgtttttacaaagaagacggctactacagacttcagcctgagaatgatgagatggatccgattattgtggatcacctggagatacttggaaaggtgattggcctgttccgtttgggaattaactagattgctgacggccagaaacacggaattttaggaaaatagaaagcaaaagcaggaagaggttgacataattaatttatgtcaacctcttcctgcttttgctttccggtttctatctgtttcgaccggcttctgaatccagtcagtttcgttcagttatttcagttcactgacatccagtgtcttcccatcgcgccagatgcgctccagatcatagaagagtctgttgtcacggtcaaagacgtgtacgatgatgtcgccgtaatccataaggatccagttggcagactgataaccttccacctgacggcaggtgcagcccattttgccaagttcctcttccacgttgtctaccatggcctgaacctggttggaattggaaccgcttgctataataaagtaatccgccataacggaaacgttgcggatatcgatgatgcggatatcttcgccctttttgtcggataaagccgcgtaagctgcttttaccatctcgctagaatgattcattgtttaatttcctttcttttcctcgtgaagctgtttgtaataatcatatgccagattcgtcatggaatccacataacagcctttcccattcagataatccagggtatcctttaaaatctgatagatgcattccttcagatccgtaaatgccagcgggcgcaccagaggtaaatccggggcctcataccggcgcggttcgatataatccgccgtgaagataatctcctccaacagtgtcatatcgggccgcccggtggtgtgccaccggattgccgaaagcacttccggatccgatatctgatattttgtctcggccagccaggcgccgtatttcgcatgaaggacagccggggccttcttctcatcttcggtcagcgtgatcttctgcttctcgcattttttgatgatggtctcattgctgtagtgctttgcgcagtcatgcagaagaccggccagttccgccttgtccaaatcacagccatagcgcatggccagtgccgctgcggtaaatgacacgcttatggtgtgttcgtatctggaaggcgtcagttttccgctcaattcgtttctcagctgtgcaatgatttcctgcattccgccacctcctgatatagatgatgctctttaatatacctggctaccggctccgggacgaatggttcaatggactctccaagcgcggtcatccggcgcagctcagccgaggagatatcgatctccctgcagtgcagcatgcggacgtcagcctgatatttctctttcaaataggcaatctgtgtttccatggaacggcctgccgactcatattcccgcactgccgccaggattacggcctgggccagtacctttgccggttcatgccagtgctcgatctcatagagggagtctgcgccgatgatgaaataaaacgtatggccgggatatttctcatgaagaatttcaagcgtctgcgacgtataggtgttgccgctgcgcatgacttcaaaatccgaacaggaaaatccctcgcggccctccatggcgagccgggtcatctccagacgtatatggctgtctgttacacggtggtcctttttgtgcggcggctgtcccgaaggcatgtaccagatctggtccagaccgtattcgtgataggcctgttctccgaggagaaggtgaccgttatggatcgggtcgaatgtaccgcccatgattccgattttccccatattcagtaactccttacgttacgccggctgaacctatggaaggatgatctttctcttcttctcttctttcgccggtttataaaggacaatttttcttccaataacctgaaccacctcagaatgggtgcgctcagccagtgtcgcggcgattgcgctgccgtcatcgagacagttttttaataccgtaatcttaatcagttcccttgcttccagagcttccgcaatggcggtggtaatctccggcgtgatgctggatttaccgatctggaaaataggctccatggtcattgctaagccctttaaataagaacgctgcttgcttgtcatatttcctccatcatattacttctcaattttatcattagtctatttgtaatagtcgaattccagaccgtacatacggacggtatcgccttcttcaattccagctttttccagttcttcgagaattccgtttccttttaagaatctctggaagaataaaaagcccttttctgactctaaattggtatatcccagcattttttcgatgcgcgggccctctacgacgtagatgccttcctcgtttctctccaccgtataaggcagcgtctcgtcgatcatcatcgacggatcgaattccttctcgaagataaccggtgtagaatctaccgtctgcagcaaatcgtaaacagcgtataaaagttccttgactccctggccgctgaccgcggagatcggataaaccttgattcccttcggttcaaattctgctttcagctttgcaaccggatcctcgtcctcggcgtaaatgacgtcggtcttgttggcggcgatgatctgcggccttttcataagatccgggttgtaggcttccagctctttattaatggcccggatgtcctcgagcggatcacggccctctgtagatgcggcatccacgacgtgaaccagtacacgggtgcgctcgatgtgacggaggaaatcatgaccgaggccgattccctcggaggctccttcgatcagacccgggatatccgccatgacaaagcccttgccgccatcgatatccacaactcccagatgaggattcagcgtggtgaaatggtaattggcgatcttgggacgggcattgctgacgcgggaaagcagcgtggatttacccacgtttggaaatcccacgagaccgacatccgcgatgaccttgagttccagctggacccagagctcctggccggactgtccaggctgggcgtatttcggtgcctgcatggttggagtggcgtaatgcatgttgccctgaccgccgcggccgccttttaagatgacttctctccggttttcaccggacatatcggcgatgacttttcctgattcaaactctttgatgaccgttccttccggaaccttgacgatgagatcaccgccatttttcccgtggcagcgctttttgcctccctgttctccgtcctgggcagcgtatttgcgcacctggcggaaatcgcttaaggtatttaaaccgtcctccacttcaaagataatatcgccgccgtcgcctccgtcaccaccgtctggaccgccgcagggaacatagagttcccggcggaagctgacgtgaccgtcgccgccttttcctgatttaataaatatttttgctctatcggcaaacatgaattcacctgtttcctttccattggcattttaaaagaaacggcttcatacggtgaggtatgaagccggtctaattattcgcttattactcttggataaacagaaacctgctttttgtctctgccttttctttcaaatctgacaacgccgtccaccgtagcgaacagtgtatcgtctccgccgcggcctacattaagacctggatggatatgagtaccacgctgtctgtagagaatgttgccggctaatacgaactgaccatcggctctcttagcacctaacctcttagactcggagtctctgccgttctttgtagatccaacaccttttttatgagcgaagaattgaaggttcatctttaacatcacttacacctcctcaaatcgaatttttatatattgtttcccatatgattccatgatattcgtaagcccgagcaccagagaattcataaggagttttgattccggactgatctctcctgaaaaacgcagctgaaagtctcccgaacgttcatcggcacttccctcaaaatcgtcttccgtaaaggtctcgatcgagttataagcggagaataccagggctgaaacggcggcacagacgatgtcctgtccttcctcaccgtacccggcatgtcctgtaagcttaagttcgcggaccactctgtctgaatcttccaaaactgttactttaatcatagtctctgcctgaattaagcgttgatcttttcaatcttcacctgggtataagcctgtctgtgaccatttttcttatggtatccggattttctcttatacttgtaaacaatgacttttttcgccttgccttctttcacaactgtacctgttacggtagcacctgctactgtcgggcagccaactgctaattcgccgttgtttactaccagtacctgatcaaatgtgactgcttcaccagcgtcaacaccaagcttttctactttaatgatatcgccttcagctactttgtactgcttaccacctgttgcaataatcgcgtacatatggcacctcctattatcattactcgccaactgtggtgcttcgcttttacacgaaaacttttagacctcattgtgcggcatactgtaacataataccatttgtcttttgtaaagtcaacataaataaaacaaaattataaagtttttctggccgtttttgccttgtatttccactttcttcttagtataatggaaaaagtttggtttgacaaggaggggtaatacccatgaaaacagatagaaggaaacaaatttttatccgctgctgctacggctattcggtcagcgggatggcggtgctggtgatcggagcgattctgccgtcggtgattgcagaggccggaatcagctttctggctgcgggcggactgctctccgtgatggcggtggggaatcttctggccagcttcctcttccccgtcatggttcccgccatgggaagacggttctccatcacagtgatgaccgccatggcgccgctctgtctgctgggactcactcttctgccgccgcttcctgtcatgtacggcattatgctggtctacggccttgtgagaggttctgttacaattataaataacgccgccgtcaacgatatttacgatggaggcgcggccgggaagctgaaccttctgcactgcagtttcgcggtcggggcgttcctggcgccatttctcaccgcagtcctgctgatgctgggatttggctggcggtcggtcgtctatctcctgatcttcatcaccgccacctctgcactcacttacggaaccatggattacagtctgttaaatgaacgggccagagatgcggcgcatttaaagcattccggaaaacgggaggggcgggaattcttaaagtcctttcagttctactgcatcgctctgattcttttcttctacctgggggtggaaaattgtattaacggctggtttgtcacgtatttgcagaataccggggtcatgagcgagacgtatgccaccacgctggtgtcggtgacctggctggtcatcatggcgggccggctggtctgcgcctcactgtccggaaagatgaggcgcagctctctcatactgatgaacgcactgggaagcggtatctgctttttcctgctgatctctacgaagagccttccgctcattacactcgcgctgatcggcttcggctttttcctggcgggcatctatcccacctgcatcgccgacgcgggaccgctgatccagggatcaaccttcggcatgtcggtgcttacggcgatctccgccatgggtggcattctgacaccccagatagtgggcggcgcggcggatcatgtcgggatcgtggcggcgatcgggatcctggtggtgaatgtaattctggtgattctgcttgcagcgattaataggaagaagtactgtgattgaggctgagagcataggaagaagtactgtgactgaggctgagagcataggaagtagtactgtgactgaggctgagatgcataggaataggtatattgactgagattgcgatgaatagaagaaagtatcgcggctgcgaacaggatgcaaagagcacagagggaaagaatatccattcagccctctgtgcttttttgacaaaaatatttactttttccatgtggatggtgcaaacagcagaagcatcgggaaaacctccagacgtccggccagcatatcgaacatcatcacccatttcgacatggccgagaagccggagaaattgccgatggggccgacagcgccgagtcccggtccgatgttgttgaaggtcgccgccacagcggtgaaattcgttgtaaaatcaaagttatcgaggctgacgatcactgtcgagagaacgaaaatcaccaggtaagccaccagaaatgtattgatggaccggatgacctgatgctcgaccggtttgctttcgatctttatgatcttgacactcctcggatgaagcagggaaaataactcttttttcaccgatttaagcagaataatgaccctggataccttgaggccgccgcccgtacttccggcgcaggcgccgatgaacatcaatacgacgagcaggcccttggagaattccggccatttgtcaaaatctaccgtggagaagccggtggtcgtgatgatggatgctacctggaacgccgcatggtggaaggccgcaaagatgctggtaaagcttccgcggatattgagggtgatgagaagaacggtcacgccgataattcccagatatgccctcgcctcctcgcagcgaagcgcgtccttcggatggtgaatcaggaataagtaatacacgttaaagttaatgccaaagagtatcatgaacacggtgatgactccctggagataatagctgtcatagaaggcaatgctgttgtttttgatgccgaaaccaccggtaccggccgtaccgaagctggttgccagtgaatcgaacagcggcatgccgccgacaagcaggaggatgacctccaccactgtcataaagaaatagattccgtagagaatcttggcggtggattttacctttggaaccagcttgcctacagacggccccgggctctccgctttcatgaggtacatgttataaccgcctgccagcggaaggatggcgagaataaacacgagaacgcccatgcctccgatccagtgtgtaaaactcctccagatcagcatacagtgggacagaccttccacatccgttaaaatactggctcccgtcgtcgtaaaaccggagattacctcgaacatggcatcctcaaaccggggaatctccctgcttaagtaaaagggcagggacccgaaaaagctgagcacaatccagctcattgcaacagagacaaagccctccttggcgaagaataccatattatccggtttcctgcgtgtcagaagaagaccggtcgttccgcataccgccatgacggccaggaaccagattccgctgctttcccggtaaatggcagcaaccacacatggaagcagcataaagatggcttccatattcataatccatcccagaagatagacgataattttcttattcatttccttcgccttttcctactttagtatatcctttaaatcatttaatccggtattggtggtaacgatgatgacacggtcgccggtttcgataacatcttttccgcgggggctccggatccttccattgcggttaatacaggcaaccagaagattgtcctttaagcgaagcttctccagcggaatgccgacgatcgagggatcgttcatcacgcggaattccagcgcctcggcgcggttagccacgattttatagagcgtctccacattgctgcccatggaattctgcatggcgcgcacgtactgcaggatggaatcagaggtaattaacttgggatagatcacactgcctaaattcatggagttaattacattttcaaaggctatcttattgacctttgtgatcagcttcgccttcgactggctggccgcgtacagcgacagcatgatgttttcctcgtcgaatccggtcagggatgcaaatgcctctgtctggcggatgccctcctgtaaaagcagctcctgatcagaaccgtcgccgtggataatcatggcctttggcagcagctcgctgagctcgttgcagcgttcgccgttctgttcgatgattttaatctgaatcttcgtgttttccagaagctttgccacgtaatacgtgatcttgccgccgcccacaaacatggcggttttaatggtattattgatgattccggcctgcttgaagaattccgtggattctgcaggaggcgcgataatggagatcttgtctcccgcctgcatctcgaaatcaccgctggggatgatgacctcctctcccctctccaccgcacagatcaggacggtacagcgaagcttgtccagaacgtcacggaccttcatggcatggagcttcgagtggtcgggaacgaggaattttaaaatctcgatacggcccttggcgaaggtatcgatcttgatggccgacggaaagcgaagcagtctggagatctccatggccgcagccatctccggattgatggccatggacagccccagctcctcccggatataacgcgtctccgagttgtattccggattccggattctcgcgatcgtatgacagttacctgctttttttgcaatcagacagcagagcatatttaactcgtctgaattggtggtggcgatgagtaaatctgtctcctggattcccgcctccatctgaaccttgtaaaccgcaccatttcccacgacacccatgacgtcgatccgctcagtgatagcgcttagaacagctgtgttcttatcaatgatcgtgatgtcatgatgttcgttgttcaactgttcggccagggtagttcctaccttcccacacccgacaattatgattttcatgtgtctgccttcccttttataagcgcggcctgttcatggaacggcctgcgtatttttttcctggtgacttccaccagattcagttttgtaatttccacaacggatgtcttaaccggatcctttgccagaacccgggacaatacggataagagttcccgctgatcctcttctgtctccatatcgatgaaatcgatgatgatgattccggataagttgcgcagccgcagctggcgggcgatttccacggccgcctccgtgttgatcttcataatcgtgtcatggagattctttttgccggagtacttcccagtgttgacgtcgatcacgcagagcgcctccgtaggctcgatgacgagatagccgccggatttcagccatacccgtttgcccagcgcttcactcatggatttttccactttgtaaagcttggacagcggcagcagggcgtcgtcataaaatgttagcttctgtaagtctccgggctgaaagcttttgagataagcctgaatggcctcgtaaatatcggtctcatccgtcacgatcgctcccagagaaccgtgaaagctgtcgcggatatcggtcagatacgacggaggggtccggtataagagactgtagcatgtccggtgaagggcgtcctccatgactctgcggtataacgcctttaagctcttaagttcttccagaatcgcatcaaaagaggcttccggcgcatttgttctcacaattataccgaaatcctcttccttttctgcttccagaatgggtttgatccgtttcttccactccagatccgacagctttgaggaaaaccccagctgccgtttaccggccgtcagtacgatgtagcgccccgtgaagtttaaattgccggtaaggacgggtgcttttgtcttgactgcgtcacggtcaacctgtacgatgatctcatcgccggccctcagcttcccatccggactggcggcggaggcatgatgaatatagccgtccgcaaggcttaaatatcccatacagccatctccgatctcgacgaaggccgccccaatgttcttcacgatgttctttactttaccaatataaatgctgccgagaatggaacgctcttcctccggctcaaggttcagggagacggtatcaccgtctgactgaaccatcgtaaggattgctccgttccatctcgtaatgatgagcttattcaacttcttcacctataagtcccaaaggtaccaggtttctgtgttcttcatcaccggtattgccgtagacttcttcacgctggattagaaaggcgaattccgggcaggactcgccccgccaccggtcatacgtctccatgatcagctccggctttaagttgtcctggcttccggcagaaaccttcatgaagatacggtctccttctgtggtaagctcgtagatggccggctttaaatccatctcccgctcacccttttttgtctttttcactgcgagaatctgatcctgctgataaaattccttcaggcctgcaaaaaaggcttccagatcctccggcgcttttccctcgcggaacgtaagcgtatagtccgcggcggccacgatggacatggcatttttcgccttgtcctccaatttatggcactccagaacttcaattccgtccaccataaccgcgttcagctgtttcaccatggtttcgcagtcgctcatggaattcacctcaatgtccatgtactctccgttgctcgtaaggccgagccccaggggagccgcaaaggacatgatctggtgggggctgaagccctcgctgtatttgatatcgatgccggcgcgccgcatggccttctgaaaataccgcatgacatcgagatgaccgataaatttaacggggccctgcttcgagaacttaattcttactttcatagcagacacctcctccaaaacgcatcccgccgcaggcagaacatctctgtcggcagttcggcgttaatttttcatcaatggcgttcagccactctctctttaagaactccttggaaacacccgcgtcgatgaaatcccatgggaaaacttcgtccaggcttcgctctctcgtcgtatagaaatccacggaaaggccgcaggtctcaaaggctttcatccagattctgttgtcgaagtattcggaccaggaatcgtagatggcaccgtttttataggcttcctcgatcagcgctccggtctttctgtcgccgcgtgccagaactccttccaatacggttaaatcagcctcgtggtaattgtacttaaggctcttctggttcttcatctgccggaacttgtccttgacgatgtaagccctttcgataaactcttctttcgtacacatgcgggcccactggaatggagtaaacggctttggtacgaagaacgaagaactggccactacgttgaccttaccgtttctctgttccttcggaatctcatagtagatttccgccaccttttcagagagttcggcaatgccttccatgtcctccttcgtctccgtcggaagaccaagcatgaagtaaagcttcacacggttccatccgccatgaaaggcgtcgttcgcgccctgtaagatcacttcttccgtcagtcccttgttgattacgtcgcggagtctctgagagccggcttccggggcaaaggtcaggctgctcttctttacatcctgtaccttgctcatgacgtctaaggaaaacgcgtcgattcggagggatggcagggaaatattcacgccctgtcccttgaactcatcgatcaggaaattcacaagcccttccaggtacgtataatcgctggagcttaaggaactcagggaaatctcctcgtgtcccgtgcttttcagcatcttataggcgtaatcttttagatattcgaggctgtgttcgcgcagcggacggtatacgttgccggcctggcagaaacggcatccgcggatgcagcccctctggatctctagaaccacgcggtcctgagtcgctttgataaaaggaaccacgggagtctcgatatagtatgcgtcgtccatgttcaccaccagctgcttggtgatggtctccttcgcatggctgttattggggcggaagctttttatggttccgtcctcatggtattccacatcgtaaaaggccggaacatagatgccttcaatctcggcggcctgttccaggaattcacggcggctcctgccctgtttcttattttctttatagcggtccatcagttcgaaataaaccgtctctccctcaccgatatagaacatgtcgaagaaatcggccaggggctccggattataggcgcaggggccgcctccgatgacgatgggatcactttccgtccggtccgccgcgtgaagcggaatctgcgccagatccagaacctgcagaatgtttgtgtatgacatctcatactgaagcgtgattccaaagaaatcaaaatctctgaccgggtcctgcgattccagggcgaacagcggaatcttcttttcccgcatgatcttgtctaaatcggtccatggggaatagacacgttcgcagtagatgtcttcccggcggttgaacatatcgtagagaatctgcatgccgagatgcgacataccgatttcgtacacgtcggggaagcacatggcaaagcggatgtccactttttttggatccttatttactgtatttacctcgcccccaatgtaacgggcaggctgctgaatacttagtaatatttcatcatttaaagctagttttctcattctttttccttatttattgtgctgtctgcacagtatttttggtttgcgcaaagggccaaactgaattgaaaagagcttgaaaatacatcctgatttgctcttatttgttcctttttcaccccttttttcaagaaaatcgggcccttttttgaaaaaaacgacaaatcttttttatcccgactacttaacatgggataacacaatatgccacaatgcataattataaggcatttcacagtattaagcaacaccattcggcagaacataatcaagaaaggacggtgaaaatgcacaatcgatcacctgtggctcatcagacggaagaatctcgtcaatgaagctgtcaaattccggaaccccgtggctgataatttgatccgagtccgtatagacatttaatgtaaacaactcatcataatgtcccagcgctatggacaattcttttaaagttgtcaaaattaaattatccttcttagcctgaattggcttcctgtgatgttatcagctgtattttatccgaatcaaatacaatatcgccgactttttcttcgccttgcagcagagagatatccacaaaagatttcacgtctacgtctgcctcatagagcgataatgaatggttctcgttaacaaaaaccatatccttattaaaataggaataatcaaacagaacaacctctttattatgtgtgtcaaaatatccggccaatgaccggtggatacctgatccccatgagtaagtaaagtacagttcgcttttaccattctggtcgatatctgcaacagcaaacgatgtgattcctaatccgccgaagtactcgccaagattatatgtctcgttttcatacaaaagaaaacccgcgcagcattgatccagcttgaaaatttgaaagccgtattcatcggaaatcgtttgtggtgtaacattatagcaaaactcattctgatacaacatttttatttcactgatttccaggaactcttctaccccattggcagacggggtaagctgaaacaggacaatattgctgttatcgtccggcaatgcgctcttaccatcactgcaagcggctacccataacacaattgtgagtgtaaaagcaaagtaatatagttttttcattccgccacctccaggaaaacgaatcaaggacacgatagcccttttacggcagttcacacaatgttcccacaaataaggcgcatttaattagttagacaacaggatattaattgtctgcagcttttatgacttctgttaaagtcatttgtagctggtattcattttcctcgccattcaaattagttgtttttagttcaaaaaaagattgtttttcaactcatcaatttctgcttttttgataatatctccagatatttttccaacttcaccagaaatatttatcgtcccacctgtcatatcttgcactgcattagtcaacaaaatctttttttcattacctgacaggatgtagaaagtcatggaatagcttgtaatataaaatcattatctaaaaacagtgtcaccttacatccggtgtcatttaataacccaagaggggttaacgcaccgagtatcaagcccataatttccattaaatcatctgccgatgcaaaggataatggtcttgtattgttgtttttacgaaactctttcaaattcactcgtttattgcctttgacagtaatgagataataatttctttttttgtcatcccgaacaaatagattttttgcatcgtattcaggatatggtatctctatattagaaagttccgccatattgtaaacagcctcgtgttaacctggaatttacacttctgaaatatttttgatttgttctaaatcaccactgcataagacttcaaggtttctgaatatcttttcaggtgaccaatcccaccattttagttcctgcaaatatgaaataattttatcatcaattcgctttctaataattttacaaggatttccgcctgcgatatgataagcaggaatatcttttgttacaactgaatttgccccaacgatagccccatcactaatatgaacacctggcataacagtaacattttgaccgagccagacatcgtttccaacaattgtatcgcctttgtatggcaaatcttccaaggcaggtgtgcatttttcccaaccacatcccatgatattaaatggataggtcgttacgcttttcattttgtgattagcaccgttcattacaaattcaatgccctttgcaatggcacaaaatttcccaataatcaacttatctccgagaaactcataatggtgggtcacatgttcttcaaacttttctgcaccatttacatcatcatagtaggtataatcgcctattgtaatattagggcgagtgattatatttttaatgaagcagacacttttaattgcttcatttggataaactgcatttggattcggtccgtattgcatattcaaatcctccttgataaattcaaagttattaatcaaaattattaaaaactgatatccctaaaatctttatattcaacccatcattgtaacctgtttctgattctaaatctaactgatgatattttgaaatgtcatacaaaactgctctatagcgaacactgccgccatctttatatcttgttggaacaggtatcaaaagcacaagtaaaataataactgcaataataatttttgatttcttcttcatctacatgatctcccgtacaaattcaaacttatcaggcaaaatattctgtctctatgaagccgacttgcgggcagcaacctccgcacagaccagcctggctatttgctccgctgtttcatttgtcagtaggaagaacattccatcattccggcattttttatatgtgtcaccattcaaggtataaacaaaacctttcacacaggtgccgctacaagcattaggatcaatcagtctcttgcaatcacgagaagccgtcattttcttttgcatatcagcgggcagagaagcgattacatctctatacctgccagcgttgtcaccgtaaatccgtgctaatacacccgacttccgaaacacccaattcattactgttttcttctctaattgatatgaagcagcataaccgctctttacttctttaattacaaggttacagccttgttctataagtttataattaagtttctcgacaaacacacggtgttttggttcaactgccgttagaaactctctaaatgaagccttttcatttgccattatctttttctccctcaacttccaattgaacaaaatcgctgcgcgatggcctgccaaggctgtggcgcagcgattttgttcaattcaaatttatccagtttgtcaaactggaaattcactaattgaaatcatggtttataaagattaaaaccatgttcccgctgataagctggtccttgtgattttattccagcccaatccctatcgctttttactttatcaaatagcctcagcaaattcttatttttctgcctgaaaagctggggatttgttttattacttctctattgaaataaacggaggaaaggtgtcggagctatcgttacgttgcatggttcttgtatccacctcaaaagacctgccatcatattcatagtgaagcttttcatttttaacataaaaacgatgttccgcttgaaatgcaacgggcttaaaacgccctccctgtatcggctggtcacgatacaatacttggtcttctgataattttagcacatcattttcaagacgcaaatcataaataccacttacgatagcctctgccgccacattttttcccgaagccgaaatgaaacgaaaacaccctgtaataccatcagtgctttttctctttgccagttcaaatcggaacaaggatacagcgctgaaatcttttcgtaatttttctcgttgtccctccttatctataagccatatcttctcatttgatacaataaacatatccaactgaaatccactctgagaatattttaaattagaaaaagatatttgatcagagtaaacgccctgtaatgccccattttccagcttgtaaactaattcatttgtaaacaacgttttaccatccacattcgcttcaatgaagttgataatttctttcattttcacctgtccgccctttcaatctgaaatacaccttctctgcaaaaaaaacgtagcccatttatcgttggattaattatacttcattttgccatatatgtatagcgtgagcgtgaaagagcccatggcctctacaggatatattcagacttgtgaaacaaagcagtcagggggctgatattgcttcactaagtaggcgttatagtaacagtatccgtcaatccagtaccagccattttcgaaagctgcaccgtatgtgccatcatggatcgggtaaaaaaacaccagataccactaataagatgccacccttctgccaactggccgctttcatccagataataaagttttccatgtcccggcaaaagccgtcatacactgagacactgtaagcagcacaataagcggctttcctactactttcctaatcttcatagattgacctcctttctctgataattatggaggccaactcttttatttcggttctgccagcagcaggtcgggagtttccgtatatttcgaagtgtactcagtcacattgaaaatccgattttgatatgatatgatgatttaagcaaaagcctatggaaaacgaccacaattaaagttatactgcttcggcgatatgataaataagaaaaaaagaaggagtgattgcgatgaaaaaaacagttttctcatttactatcaaacaaaaagaaaaaaggagaaattactatgagtacaatcacttatcaaaaactatgcaaaaaccacctgcatgatgaggttctcgacaaatttaatcgttaccaaaaagtcagccgttgctggagaaaacaaaatgatgaatgggttctgatagatcatccgtatattgaagattgggatttagaaaaaaaacggaatattgtatccgaattggttaattgcgttaacaacaacggagtggtttatggagcgattattgacaacacgttaatagggttttcctgtatttctgctgattttttcggcaaaaataacgagtaccttgaactgttaatgatgcaagtttctacagaatataggaacaagggcattggcaaacagctttttaaattaattgccgatagtgcaaggcagcttggtgcaaagaaaatttatatttctgcacattcttcagaggaatctcaggctttttatcgagcagttggttctgtagatgcagtggaaatcaatcaagttattgcccgaaacgaaccctttgattgtcaaatggaatatgtactttaacgacaaaacttaagtagcagaagccagccgcccttatcaacgataaaatgaacgtcatgccgttgttgacaagctcgccagcctcagcttatgtggcaattaagagggcgaaagcaaagagggctttcgccctctttctatgatgaaatgaaagtcacgcaataggaaccagtacagccttgatttgagcggttttcaagatacagaaaacacccagtatccatcgtatgcatatcctgttttaccaatcagcaaatcttccgttttagtaaatacaactttcttaatagcattgattctatctacagcatatatttgagcctttgtaaacacgcctttacaccctaacaatgcatcaatttctggtgtgataagcgaaaaaatatcatactctcttctatgacaaaatccggaagcggccgcggccgcacttcaatcaacgtatctctccgaacactgttaattttcatattaccaattttaggattaatatagttatatatgatatttcggtacgatacatatgttccgtttgctattttaacatcatcaatcatatggtagtaaagccgataatcataaaactcttttactgttacttcaaatgcaacaaattcatgattatgtgattgtacgctcattttttatattgccatagtttccaatacacagaaattcaccgcccaccgtactccaccactttccctctgccggaattcttagccatatacatggcggcgtccgcgcgcccgactaactccccgaatgtgtatgcctcctcctcaacccaggccacaccggccgatattctgattggcagctgctcaccatcaggcaggacgattggatgccggtcgagtgtatcaaagaaagacttaatctgctcatggagagcttctctgttctcatagccgtacagcaacatgaagaattcatcccctgaccgtcttcccaccacagtatgttcctttggaattttcatcatgcacacggccgtctctttaatatagaggtcaccgtactcatggccaagccggtcgttgacttttttcaagccgtccagatccatcataaccatggccgctgtgccgatttccttttgctggcgcagcttctcctccgcgcgtttccggaatgcctccctgttatagatcctggtcaggctgtcatgatcccgttcgtactgaatcctccgcttctctgtcatgtccgctgtcacatcttctatgatccccaaggagtttccctggtgctgcgacatggaaatccgaatccagcgctccgtttcaccgtccctgtagacatccctttcctccggctccggatttttgcgcacctcatccagtctggccccaaatgcctcattgtccacatacaggcggcctccgtcctcctccggcaggttcagaaggccaaatatctgctttgtaacctggacctcaccaccctccggactatattcaaaggcgccgatcggtatacccacaagatccataatatgcgacatttttaacgtggaatccaacaggttttggttggatatttccactgcctgcgacagcagatccagctcctcaagtccggtccggtccagctttattttcctggtaaaatcaaaattccgaaccttttccgccagttttgtgatgggtttcgtaatcctgcggctgataatgccggccgcaatggcaccgagaaccagggataccagcaaagcgaacaggaatatccgcaaaatggtgtatggaaagctgaataatgtatcccccttcatcaggccgaccaccacccagtttccgctgtcgtagggcatatttttagcattatacagatccagacttttgatgcaggcgtagatctctcctctgctgttcgcattctccacttggcagatcgaatacttaccgtcctctcctttcacctccaggcggtcaacatttccaaacagccgcttttggtactcccccttccgtatcagagggatcaggtaattttccccctccggataaacggcaatcatgtaacccggtgaatcctgtgttgctaattcattggcaggcagaagcttttttatatactcctccgatacctccacgccgacaacgcctctcacctcaccgccctggtcaaacaacggcaccgtataggtgatgacaggtacgtctccgggtgttattgaaaatggttcgctccaataccccagcgccctataatccagggactgaccggccgcgctgattggcatcctgtaaaaatcctggctgccgccttcctgggagagaccataatgccagacgctgtccaggggaatctgatattttctcgaaatatcagcaggtcccaacacctgatacagatcgctgttgtccgtgctgtttgtctcaggatcatagtccctgatgtacagtcccgcatggctcttcgcctcccctgtttcatgcagaatcacaaatgttcctgtagttccgctgaccctgagcatggagataagagtatcggcaacatccgtcagatatgccttctcctcatttccatcccagtcagcaggcagtttccgggacaattcctggacataagggtcgatattggtccatcggttgtcaatctgatccttcagggaactggctctgagcgttacagtagactcgaaggactgatacacggtttccctggcctgttttattattcccccggctatcagcatccccagcaccagcagcgactgtgtcagcaccaggcagactgtaaataaagagtattttgaagcaatggatttccatttccatttcatattaataattaactccccactatttttgccatgttatcaagccagccctcgtaccatatacgaaaatgggcttcgtccgtcaccagcttttccgcttcttcagggggcatccctttttttgtttcttcctgaaccttcatgcgggcactgttgaccgttgtcatcatgtaatcattgtagaactggcgcatttcatagctgccgctaaagggcggattcgaataaaaatgatattccgccagcattttctgagttgcctgcgcagaaagcccaactgccggattcacctccggagcctgggaataggattccattgccctggtatatacctgctccaacgctccgttttcaacgggcagatatccgctgtccaccgcaaaatcaagattctgttcttcctgggtaagccactttaaaaagaccgctgaggcatactcatgggccgtgtcgctttttcccatagcaaatcccgcgccctgcaccatcgcccagggcttcccctcccggaaacaggggtatggaagcacagcactttcgatgttataaaccttatcctgacttagggtaacctcctggggaaaataggccgagcctgcgctggaacccacatacatcagaatatcccccaccttttcatcatcagagcggaacttgcccagatttgcgtagtatcccttcacatatggcacatacagattttcccatataatacgggccagttcttcatcaaatgaaaactctgcctcattgttctcaaatttgtagatattccggtccgtctgcacggacgcgataatgatatagttggccagactgtcaattcccagcaatgccttgccgccggaccactcataataagcttccgctgtctctacagttccctcccaggtagaaaggctgcccaaatcggcccctgtttcgccggaaaacttatcccaatccgtcttgtttaaaaacaaattttccgtggaccgcaccaccggcatgattttaagaccatattctctgccgaagctgcaatcctgtaaaaaatcggtccggtaagcactcagctcttcctccgaaaaatactggttcaaatccaccagcattcccaactcctctatgcggtaggcgttctccggatatgccgcgaacaaattgggcatcgcatccgcccccagtctcttgctggccgcattgaacgtttcctccgcaagctggttaacatctccgtggctgacgctctccactataattcccttctccatgcctaacgtatcgttaaaccgtgacaccagatcatcaaacgcactttttgtccgtccattgtaataattccagaccgtaatcataaccggctgcttaggatccagctgatgttcagcctccccaccacgcgaacagccgcttcccgcaactaaaataactgccattaccacagccatcaggcgggcacaccgtttttttatcatactgtgcctccctactattctatagctgttattttatcatgtttttaaattttaggaaactggcaatttaaccggcatacccccttcgaaaataacgaaaatccccggcacagctgttatgtatattcaatgcagaatattcaacaaacattcagccatgccggggatttccttatgatcagttccgccgtaattcattttaatcacacattaatccgctctgcatacgcctgtgggcgagatatttactttcccttcttgcattgatatccagccgtaagtttatcggttatgcctacgcagcttctatgacggcagaactggctgtagaggccgtaagaaacgcctgcctgaatgtgaaggagaccagaggaatccttccacatacatacgaagacgctaaggaagccaggagggcaattttcgagtatatagaatcctggtataaccgaaaaaggcttcacagtgcaattgactatatgacaccccaacagaaagaagatgagggatttaaaaaagcagcgtgagctttcaactttttttgtccaaagtattgacataggcccagacatagacaggaaacaacttatgatgaaaggacctcaaccgcacagctatgtttcttatccaccttatcatagctaatgccgacagcaagaatccttccaccatactgtggagtttctcccaaatgccccctgaaccggagtgcatattctttatcttttatttgttggatcgcctcctgaggtgtatggcctactttcaactctaatatgatacagtccgcacttttgtctctctccggataaaagataaagtccacatatccctttccggccttgtcttcacgttccactttataaatatcgcgtgccgccaggtatacaagatttatgattgcggttaattccgtctcatgattatagcttaaaagaggtacctctgtattgtgcgcctgctccagaatctcagccatcgttttcgtatctgcatcaagagtggcccgaagcatacgtccggactcttttgcaagattatatacatatcccaaagttggtttcttttgcagcatgtctgaaaatttatccatcagctctttgtttggaatcgataccttcccattttcaaagcttaggaatccataaaccaccatggcagagaatatctcctccctggtactgagattcatcgatgttgccgcatattccctgattttgatagagattgcctcaccggaaaccataagtgccaggtcgtcacgaactgcatccacacacatgggttcaggcccagcaggatactctggagcatttcggcagtaaaaagctgacgcctgctcccgtcaaacgcctcatactcagcttccatgaaggcgtaaaggtcaggcaggatcggataatcctccggatccctccgtcgtgatcactctggtcactgatgttccatctggcataattaatatgtaatgctacatttatgttattttctcccttcctactttgggccaaattggccgaagctacaaaggctggctgtccaggctgttactctcctcctccacatgattcacagtaatataaatcctgcgaaccggcagggtcttatcgatgatcctgtcgtacagatccatggtggcgtccataatcagttttgtggaagaagtctgccggtttagattcgccgttccatgggcgtgtatcggaaccctgcggccatagtgatctgtggtgacggctcccttatactgtttgttaatttccggtctcgtcagattctctatatcgcagcctactgtgagcaccacttggtctgttacaagccctttatcaactaaatccaataccaacaaatccgtcatctcctggacaattagttttgctttgacatggtctataagaagctctgcattgatgccaacagcttgtagagcatatcgtttgcaaggaaccaccgaaagttttctccacaatattccggctggcattctgtactacctgttctcacaaaacacaggaacgcacgattaagttctcgttgattagaactcccttgaccaccaatttttttaacatggtacatgttgtggatttcttccagcccagatttttcgttacataatctaaccaattcagaagactgtaccggctcgttttcccacacgatgtctgccgggtgaaattcgctctcccataatctcagtagttcctcattcataaatcgtcgccccctcagtctatcattgtaatttaattgttcgcaaaaggtctattaaagcaggccttatatgtcgatacattagcatactccttttacatatatttacatgcaataaaaaaaacgaaaagagtccactgtttagaactcttttcgttcattgactatatgcacatatatctcttatacctggctccgcagaaactccaaaaacttctccacgccgccgcccagcacctgtaccttatctggtctggcgccagccgcctctgagacatcaaagaaatccccgcctccggtcaaaggcgttttcatataactatcactgccaaacaaaccatcatccagcccaatatattcgtccccccaataagcgcagtcctccggcgctattgcgtcttcttccattaactgtgtcaatatagtattcacattgtcacttttgctggagacacccacttccaggtattttgcatcggtcgtagatgcagcttttacgccgtactccgccgccgtctcatccgccagcttcacaagtcccaggagccctccgtgaaaattatgggtcgccagagtctgtttcacctgatcaagttcgctggactggaagaacaactgatcaccacggttattatccaccatcagatcgatcttgcagtaattggggcggctgaacaccacatcggtgggatagccgtattgctcaagcaatatacggtgaatcgcgtaggccgtatcatgaatggccagcatctcctcttttccagggatgcagtgcttccagatatacggcgaaccgtcctcgtgataacggtaattatatgcgcctctgcccagacccagccacagatgcgttaactcctccggtgtaaaatattcatgcagacgccccccggctatattctcatatgttgttccgctgaccaccaccagctttatgcctttggccaacagaggtttcatcactgctaccgcgtcatccaccggcgccttccgcgagatgacagcagtgccatcccaatcaaagaaaattgctttatattgtttttgactcatggacgatatccccctcctttgcgagatggtattccgtattgttaagtttaaatgagacagcgtttccctgctccagtgtgatctgggtgccatcttcctttacagatacttccaggcggcttccctgataattaatcttaaaggtatagcctttccattgtgacggcagatacggatgtaattccagacacctggcattcgttctaagtcctgcgaaaccattgacgatcgcctgccaggtgccggccatattggccgcatggattcctgcgtagaagttattatgataatcatccagatccattctcgcggactgggtgaaatatgtgtacgcttcctcataatatccgatttcacaagccaggataccgaagatgcaggtcgagagcgaggaatgatgtaacgtgacctcctgatagaaatcataatttcgttttaattcctcttccgtaaataagttgctgtgcagatacatgcctaatatggcatccgcctgctttgacatcctctggcggtacacaaaaagcgggtggaaattctcatacagcagatgacgtttctccggggcgatcttagaatcatcccagggcttgcgcatcataaaaccgtcatccaatgggtacacctgacgtttttcatcatatgggaaatacatattatcaatgatccgctgccagtagacagtctcgtcactggtcagtccaagcttttctatcaactgctgacaggcagccggctcatgctttttcaaaagctccaaagcttccaaagcattccttaagttctctctggccatcagattggtgtagaagttattgtcaacgatagcattatactcatccggcccggtgaccgcgcagatacagtaccggttccccttgcattccgcaaagctgcccacatctgcccacactctggccgtctcgcacaatacctccgccgcgcaatccttcagatattccatatctccggtcacagtcacataaagccagaatgcatatgcaatgtccgcattgatgtgatactgggctgttcccagcgggaaatatgtggatgcttcctcaccattgatggttctccacgggtagagtgcgccggtctggtgccccaataccctggcacgatccctcgcgatatccagagtattgaatctgtagtccagcagttttttcgctatatctggagctgtgtagataaataccggcataacatacatttccgtatcccagaaataatggccttcgtaaccctctccagtcagccccttggcccccatgccggtcttcccgtcacgcccggcggcctgcataatgtggaataaattaaaacggattccctgctgcagagcatcatctccatccactgtaacatcagcgtttttccagaaatcatggacatagttcttgtgagatgcgcttaatgaatcgtaaccttctttttgtgttgatttcaatttgcataacacaaattcatgcagatcatcttttgccatgtccagatctgatgcatagacgataaatttctccaggcacacagtctcctgctctgctatttttatctgataatcagcatctgccgtgtattctcctgttttaaaaaatactgaataattttctgccgggtaccccgttaatttatgcccttcgggcaggggcacgacctgcgacaaggtatgagtcgccccgcaggccatcgtcagtccgcttttcaacgtatgcccctgataaaacagcccatcatcgcctgcctccaaagcttccggcacaagccttcttccaaatggtccataatccacaagaggattcgtcactctggtatgattttccacatccccattcagttcagatacaaaccggatcgttccgctgaaattcagcgctgtcacccgatacctcatcgccatcagattcttatccgtgaatgaaacaaagcgttccagttccaccttcacacttcgtccttttggtgacgtccagacgaactcccttgttacggtgccttccttcatgtgaagcgcgcggctgtactcagtcacagccccttcgcgcatatccagcatctcatcatccagatacagtctcacagcttttacatccgggagattgagcagcgactggctcttttcagggaagccaaaattccactccccgtaccggatatcctcgctctcatagaatccattgataaaattcccttccagcccttccgttgcagggaaatcataggcttcctcataggttcctctggtcccaatatagccgtttgacaaggcaaaggttgtctcattccggtaattattctgtgggttatattctgtctctgtcacatcccatggttcgatgggatagattggttctctatactgttccataaaatctcctcattccttactctttcacagcccccgcagtcagactctccatcacctgtttctgcagaataataaatataacaatagtcggcaacaccgtcatgactacagccgcaaacaacgccgaatagttattcgcaaaggtacccatataataattcaaagcaatggggatcgtcctcgcacggtcaccactggtcaacataagtgcgaaatagaactcattccatgtattgataaactgaagcatagctatggtcaccagccccggtttcgcaagcggcagaataatatagacaaatgttttgaaaaatgtcgctccatcaatatacgcggactcttcaagcgccggagaaatggtcttataataactcatcataacaaagaacgacataggaattcccatcgccgaatacacaatcaccagtcccagcttcgtatcaaatatcttaagcgccctcataatcgtaaacagcggctgtgagatcgcctgtgccggcagcatcagagatgcagagatcagaagcacgatcactgccttcatcttaaaatcaaacctggacgtcacgtaggcgcacatagccacaaacatcactgtcaccaacacactgcagcctacaatcatcacactgttaaagaaatattttgctatcggcgcatactggaacgcggaggcatagttcttaaatgtaatgctctttggcaaagagattgcggaagagttgatctccgcataagtcttaaaggagcttaaaaatgcccagatgagcggaccaatggcgatagcaacgaaaaagatcatataagcatatttaaaaatgctgcagattacccgaatcgattttggagtctctctcatcttactttacctccttcttgatcttttccttgcccatggcaaacaatccctgaatcagaacaaccagcacaagacctacgagaatctgaacaacacctacggcgttggcttttccgtagttattctccagcgtggccgtcttgtacagatagatcggcaggttcagcgtcgcagtgccggggccgccttttgtggtcacatagataatgtcaaactgtgataccatagctacagatgccagaaccacacaggttcctaccacatttttcataaggggaagcgtgatgtaacggtcaagctgccacggtttggcgccgtccactctggccgcctcatagatcgaggtatcgatagctcccatctccgccaggaatataatcgtgttaaatgcagagtagaaaatccaggtgcaggtcacagtccagaatgcaaatttggagttgccgaacaggttgggaatctttgacatatcaaggccgaacacgccgtacatagatttgaggataccaaagctggggtttaacagaagtgtaaacataacgccggtcgctgctgtcggaataatattgggaatcatgtaagctgttctcacaaacttccagcccttcggttttcttctcaacaccagagccatcaacagtcccagcataacgtggaatgtagactgcagagctacccataccagcgtattttttatcgagatcagaaaatccttatcgccgaaaataagctggaagttcttcaaccctgaaaatgccggtttcgttgtgattgtgtaatcgcagaatgaggtgaagagcaccgtcacgataggcactgcatatacaatacagaacagtaccatacagggcataacaaaaagcgtgatccacaaattctttttcttaaccataataaactcctttcacaattctttcgtggaaatatgtaaatataaaaatgtgtaaattaccaaaccattgtaaacaaatatttatatgagcataaatatagcgggaaaggccgacggccctttcccgcccagattacaagcattctacgctctcgataccgggagttcgagggcagagccctcgaactggaatcacgaaggtgaaattcacttccgcacgtatcctaaaatttatggcgcagccatgaattttaattcttcgctgctgactcactaagcttgttgcagaactcttccggtgtcatattcttatatgccagctctggaagtacggtagagaatgtatcgattacgttctgataccaatatgcctggttctgtccatatgtatattttgcaagcggctgtaaatcaagtacctctgccatcagaggatcactgctctttaagctgtcaggaatggtgatctgagaggatactggctgtaagcctgtcatctcaagcgctttgacctgattttctacggttgtctcaaattttaagaatgcaactgctgcatcaatcttagccggatcttttgcgcctaccatgtcgccaggagttggaaccatctccataccgctgcatggaagaagcataacgccaaccttgtcatagaagccttccggagctttctctgtgttcttgaaatccgggatcatccaagggccattcgggaacatagcaacttcgccattgaagaaatgggtagccatcggatcatatttgccgccaacagcatctgctgtggtgtattcgctcagcattttctgtaaatcggtggttgctttgatcacttccggtgtagcataatctgtcgggtacatggtgttcatccaggtatttcctgcatcgccggcagttccgatcagtccgctgtaccagaggttggtcagccagccgctgtctgctgtatccatacctaacgggatacatcctgctgcttttaacttctcacatgctgcaaagaaatcatcccaggtagcaaaaccttcttttggagcctcgataccagctttctggaacagttctttattatagtagatgtaagaaatctctttggaaaccggaacaccgtagatcttgccgtcaaccgtattgaattccagagatttatcatcaaataatgctttccactcaggatccttctcaaaatatggtgtcagatcggctaccttaccggatttagctgccatctcagtgatattatttccaccgttcagaacgatatcaggtaaatctccgctggagatcaataatttaattttctggttgtaagcatctgttgtaggaatttcctcaaagttgaattctacattcttgcctgcgtccgtctgcttgaatgcgtcaaacagataggaataatattctgctgcgtaatctgtacctacgtggtagttgatcacatttagtgttaccttgtctgcagtagtacctttatctgctgaaccactctcctgcgcttttgtggcttcagccgccggctgtgtgctggtaccggatgaacacgctgtcatacctgctgccatgacgcctgccaatgtcatggctgctgcacgtttcagaaaactttttttcatatcatttcctccttgtattatatcgttatgatcgtattatatcggttctgagagtccatttgaattcagattcttgcccgtttctattaaatatttgcataagtttcgattgattttgtacgaaattagcattattttactaaaactatgaaaatcttgacattttctgtgaaatatctgcgcattcttcaaattccgttgaatccccccaattcctatgagataattaatgcaattactttcattcactggaagaggggaatcaacatgaaaatcaacacgcttcgttcctttatcacactggctgtatccgcaaccgtggctgctgctctgttttgtgctgctactttattttatacgaaaagtgcggacacactcaaggacaattacagtaaagatatcaccagacaattgaatcagatcaataaccaggtcgaagatcagatcgacatcatagattccgtatatccactgttcatgtccaacaatctgatccgtgaatatctggacccggccagcagtgtatacaccagcaaaagcccggtagagaagcggctggagatcgagcgccagatgagctaccttctgatcagcacttacctttgggatgaaaagtttgtcaattccgtctatatatttgatatgaacggaggctactccaaagtatccttatatgagaataattcagaactggaccaggtaaaaaccatatatgaccaggtatccaaggaaggtgcctccctgcagatcaagacattaaacagcgataaccactcgatctatttctcgcggaacgtgaacagtatgtacacaggcagtcagattggcaccattatccttgatatcagccaggatgcctggaagcagtcatacagcagaaatacggacgagaactggctgatctgcatctttaacaaggatatgcaggtgttaagccatgcacagtccagcaacactgccgtatttcaaggtctgatggaacaggcttccaccggaggaagtccattcagggaaatcaagctggacaagaccagctatttcatggcctcccagcagttgggtaccagcggaatcacctccgctgtggcagttccaaaaccgtacttattaaaggatttgaaccagacgctccgaagcttcctctttatcttcctgatcatcatctcgattacactggttttcaccattcttctgagccatctgatcacggcacccatcgagcgaatgatacagcacattaaatgtatcgccgatggcaaacgggaacaagccggaagcgctccggtcagcctgtattcagaatttaatgatctggcgggagcatttgaggccatgcttgaacagcttgatatctattacaatgatatttaccagaaacagcttttgctgaagaactcagaaatcaaggcactccagtcacagatggatccccattttctgttcaatgttcttgataccatcgcctggaaagcacagatgagtggaaatgaagacatttaccagatgatcatatccctgggtgagctgcttcgctccaacattctgtcccacgaaaaggattttgtaagtctggaggaggaacttacctatgtaagattctatatctaccttcagcagaccagatttgaggacaaatttaccgcggagatccacgcagacctggacgcaaaacacatcacagtgccgcgtttctgcattcagccgcttgtggagaattccatcgtccatgggctggaaccgaaagcaacctttggcagactggccgtgaacatcattgaacaggatgattttatagagatcaatgtggcagataacggcgtaggatttgcagattccaaatcttccacagagcacggcagtgcagactcaccgcttaatattgataccttgaaaccctcaaaggaagactcccgcacccatatcggtctgcgcaatctaaacaagcgcctgatactcctgtatggtgagaattgccgtctgcagatcatgagtatcccggacaaatgcaccactattacttttaaaattccaaaagaaagaggaaacgaactatgacctttcatctgatgatagtagatgatgaacctaccataagaaaaggattatctaattttatcaaatgggacaccttagacagtatcgtggatgccacagcctgcgatggagctgaggccatggaactgattcgcctgaagcagccggatatcgtaattacagacatccgtatgcctcaggtggacggtatcgccctggctaaattcatatacgaagaatatcctcagatcaaagtgatcctgctgacgggctacgccgatttccagtatgcccagtcggcaatctgctatgccgtcagcgattttttactaaaaccaacctcaaaggataagctgattgaagccgtgaagaaagcccaggctgccatcgcagaacttcggaaccgaaccgtcatccagaaggaagacttctcctaccttcaggagcaatacctggcggaggtcaccagcaccctcagaaccgacatcgagcttctggagcgcagttcaaactataagattgaattagacaggtattacgccgcagcattccagatcaacgcaccgcacaatcaagtaaacgaacatgatatctccgccctgaagagcattctcgcagggcagtcagagactggctacgtctatggctatgagaaccgtctgctgatctggctgtaccggacagagctggcggatacaaggcggcttcaggagctaaggaatacctgtgatgaactgctgagcagtatgcagtccctctatgatatccgattgaacgccggaatcagtctgcctcaccgcggactgggcgaattatctgctgctgcgattgaggccatcggtgccctaaacatgaatttttataatgacgcttccatctccgtctttgaaacaagggtggagagggagtattttgacacggaatcggaattcaccatggaactgtaccattttgaaaatatgatgaaagaatgggcttttgaggacgcccgaaaatggattcacgtcctgttctcaaggctccgcgtcaatctgacccgctcctttgacgtgaaaagtgtgtgtgtacagatctattatatatgctcccgcatactgatcaaaaagaatctgatcccgccctctcccgcaatgatcgagcagctgcagtcctgtaccacgctgagccagctggaagataatatcaatcatctgtttgaccaggtaaccgaaatgctggccaacaaaggtatggtcttaagcccattaatagaaaaagctatgatttacattcactcgcatctggatgaagcgttgtcgttggagaccattgcagactatgtccatgtgaacccaacgcatttgagccgaacgtttaaaaaagagtgtggggaaagtattacagaatttatcaataaggtgagaatagagaaggcccaggagctgctgtctttttcgaatacattggcttatgaagtggccgagaaggttgggtttaatgacccgtcatacttctcttctatcttcaagaaatataccgggctgagtcctaaggaatttaagcagatgcactctatatgatggctttaaccgggggctaaggaggacgccataaaagccgcagggggggagagctaaccgtagcacccaaagcttctggcttcgtagaaatccttcaaattggcgggagctttttcctcaaacgtacaaaacgcacatgtggtatttgctgataaaatgacagctgcccatgcgaaactaactatgactccactcgccttcattaataagttttttaatttcataccttgtatctcctgtttttcacatattaccatattttagaaaaatataaaacgtacttgttaaaacgggtatatattaacgtaaaaattggttttctctgtagaaggaaaaggctaaccataaaagtattgtcatgaaaagagaactcaatgcttccatcatatttttcaacaaccgtgcgagcattatcaattccaaaaccatggtttttactgtcctttttttctagtaataaatcgggaaccatccatactcacttcgccagtgaatgggttctctatactgataaataacatattggagtctgagcgcatgacaaatttgatcatcttatgattgcagcatctgactgcttcaatagtgtttatggcgaggcggctcatagcatattattatccatggaaaggctttgtgtggagtttcatggttaaaatcgccaattgtatacctcttcatttagttccggcttccatgctgcaaaagcattgacaccgatagacgcggttgtcggagcggcaataaccagagtagtaatcatacacaatcgagaataacccccaagctgacaatgatccagtaaacatttggagaccatgctccggctaagagtttatttcttcagaaaatcgtaatggaaactttatagtatttttgtgcatttaccaggcaaaaccgttataatgaaatcaaagcagtgaactatatgggaggattataaaatgagaaaatttataaaaggaaatatgaaaaaaaagaattttacatttttggctgtaatgatggctgttatactgtcaggctgttcgctggcggagacaaaaacagcggagacccccgtggaacaaagcccgtctattaacgacgtaaaaatggaaagccaggagtatactgccggaatgccggaagaatcagcaagtgttgcggcggaaacgccagaagaagcattagcaatggaggaaactaccgaggaactttcagaagatgctctggaagttaaaaacatcgcagatgtgttttgtacagcttactttgaccggaatatagaagtgataaaaaaatatttatccagttcatatgaagctcctgttaaagtgcttgattccgcagaagaagttacagatataactgtaaaaggattagctgatataaaagaagccgatattggagacggatacaccgtttcttgcgaatttaagccgaatgcccagagtgatacgttccagtatttgacactagagtttataaaacaggaagacggctggaaaatacaggcttatggtttagaactttaattgatgcgtgaacaaacatggaagtattcccaatgagtaaaaacgctataacagtgatatgtttataggcgcgaatgagcggcaggaaataagttgtttttccagccgctcattttgtttatacatttgattataactgccaagatctttttccattgctacgatcgtacgcacaatccacggcatagccaaattttctaagcctctgtgcaagggcgtcggacaatatttcctcgtcctctaccaaaagtaatttcatttaataactccctttgaatctaacagcagacgatataattgcccgatatcaaaaggcttgggcaaaaagcccgtcatgccggcctttgctgcgatttcccgatacggtggcgttcgagagccagccggagcttttcctgttcttgcttttctgttgtgatgtcgatcagcacgcagctgatgtaatcgattccgctgtcgtctgtatgcagctggctcttatctaatatccaaagtacctttccatcttttgtagccacccggtactctatttcaaacgtattgcctttgttcttctcgcacagacgccaaactaccaatattttatgctgattggggatatccgcatatatccgcaggattgtcacctcataccagatatagtctccagtgaagcaatgttcctgtcatctggatgaactacttcctgcaaaaacactaaataggaggcctcgaactgccccaccggacacagcttgtcaaaatcattgttctgcttatagaccagatgatagacgccgctgttcatatccacctccattacggtggaattctcgtagcgcagcatggcgaaatatttcatctggccgaattcaagtgtattgatttcaaatgacggttcgtttatacctgtatcatgatttttcgaaaagtgtatctgtggggcgtgtccatccgcatattcatcggcaattctggcaaatatttcacgaagtttgctgtatctgtctcaccggtcaacccggtaaaacggttaatcaagaaaggactgtgaaaatacacaaacattacaactcttttgccgtatcaaagatggcctgaaggccctcagagattgtaccggagattgggtagagtatataattcaagtcgtggtcatgcatttcaaattcaaaaaaatgcaggttggttttcccggctgtccggaacgcttccgcgatttcacgggattgctccactggcacgtttgcgtcaatggttccttgaaaaatataaacaggcagggtgagctgtggcagagtctcccagtttggcgggatttttctgtgtgcctggaaccatgccgatgtcagacggacgccataattctccttcagccacgcatcatctcccccatcgaaagcccggaaggtctcgtcatgagtatctttcagcattagttcaaaatccttccgattaatctcaccgtcgctgttgacattccatttcttcaaaggcaccgaactgtgctgttacctgaaagggggcgtcgtcgtactctgccttcgtgaccgtaccgtctccatcgctgtccagatatgccccgacgttcaccatactggatccacctgtcagctgccactctaaaatgtctgccatcgttacattgcagtagcccgcgagaaaaagtgcgtccacctgagccttgccatcgagcgccaccaacggcgcgatcatagtaccctcgctccaccccagcaggatcacttttgcgttctgcagtcggctgtctgctttcagaacgcggatgatcgtttccacgtccttaacttgattaagaggaagataagactggtaggcagcttcgtcaatttccgcaaaatagggagcctcgtttccaaccgtcacaccgcgggtattatagctgccttcctgtgtaaactgctctgcaaacaggtcatggtaattgaacgtgacatcacccgcctggcgcttgttgtcataggtgtttgggccggagccattgatatagattaccagtttatccgcggtctctccctctggtaggcgcagcttgccctcaaacttcagcccatcatgggcagtgatcgtaatgatttcctcctgtgtttcggactgggagcctgtgtgttcctccttgtctccggatggagcgcaggcggacagcaccacgcaaacactacacgtcaacaggactgcaatcgtcctttttatcgtaaattttataaatatttcgcccttctctgtattttttatcttttcaaattctaatttatcgctggatttattatacttcatttctacatataattatagtgtgattttgttaaacttgctgaccaggaacaccatgcattgcaatctgttctgagtcagcaagcctgtaaaaggtagttattactatactctcctttttcaaaattactttagggcaggcatttacaacgttcttaagagattattaattgaaaatccccctctggtatgatagggtaatattgaactttacaggcgattccaaaacattaaaatcctatcatgaaaagaaagcaaagggattccattatgataaaatcaatgaactttttcgttcctgctgccctggcggccgtcctgctgtcaactgtttcctgcgcaaaaacgccgatttccatcgacagtgaatccgcctcttcttcccctgctgccgttcctgacatgccccttgggacggaacctgtccagactgtcagtccgctggaggaatacctttccgtcgttgaaagatatattgacgatgtcatatttcagacagcggacgaagaagatgtaagacaactatcggacaagcttcaggggcattatgagatcaccggacggacagacggcggcggactggaatattatgtagctgtcagacgtgaggatgctccggtatatgacgactacgattcactgaatgtgggggagctcgatgctcagctttatgttggttattatgaccaaaattccgatcctgtcgtcctctatgagttgggaggctactccctgctggacatgccttttgggtatgataccggactggacagcttctgttttggaaaatacgatgatgacgccttgacagagaacccatcctttctctatgcattcagccaatccggcagagatacgcttgatttcatgaagagcaggccggaactgtccttttaccaggaaggacagtcttatgtccagttttattatcaggatgagagcacgataaaattttattctgagccatatacctgcagcatcgcccttaccggcgcggagcaggaagaactccgccaaaaactggagacttctaagaccgaagaaggcatcgggagcttccaggaagccatgacttttatgcgtaaaaggggcggtataaaagacggaatctactccacaggttcctccctgctgctcgacggccaccgctataagagcttcggtaattctgagtttccaggatatttgatggttttggatgaggaaacgggcgatcttctctccctcgaatataacgaggatatctgccggttcatcagggaaaaagtgaaggcggccgtcggtttggattatggatatgtggattccggctggtttaagacgccgctcaagagtgcttctattgcatttccagaatatatggggataagcggcgccgaagaggcccagctgcggacacagactatagaagacaggactaagctggatgcccttgaaaagctgatggatcaggcgctgaacaacggagaagtctacggattttccgcctgcccttacgttgcccctgttgattttgtccgggaggacggcgagacgctgcgcatattcgttgccacagattcctgtgattccatggcctatgagggccggatcagcttcgaatacggcaggcaggccgatttggcagccatctttgatgaggcgatggtgaaacggctggaggaatagaacataaaaaggaggagcatacattcgctcctctccatcaaatgacgccagtttatactgtttatttcgttattctgtcaaccatgccaataactctgatttcacctgttccaaaatctgttgtccaatgatttcgtctcctgcacttcctgctaaggtacagttgaatgtgcatacatcccgaaaggtactaattgtcaattgaaaatctggtggaagccgaaatgtacctgctaaagagcagcttacaacatcgatatttttaaaataaagtctgttgtggtctgcaatgcccatattcgtgtatgaaacaggaagtacgcggtaagctgctttgactgcgcaagacagtgtggggcgaaaaaccttgttgaatatacaatgcagtggccttattccagcaaagcagcggtatcctgccttttgaagtgtcatttcaagatgaacctgcacaagcgtcgtataaaatgtgtgctgagacataaattcaacggttaatctcttgtagattccagtcatattagctatggttaaatggtcaggctctgattgaaatctgcgcagatcagccggacaaggaatgacaaccttattgatatgttggagacgggcaatcacgcgaacataggccgtcataaaaacatcgttgaggcttacaccgcatttttttgctttcgcctgaagtgctgtcagatcatcggacgtaatgctgcagtttaaccagaaatagttcttcccatttgaaacaggccgcaatggcggaacggcggtatagcgccctcttctggtctgcacggttggcggctgaacatgaatatttttcaagagaggggcaatctctctcttgttttgtaaatgaacagctggagacttgccgttatataaagaggccaaaaggtacagatattgtaaaaatccattgccgtctgttagtatgtggctcattccaatcagaaccgtatcttttcgctcttctctataaatggtaattcgaagctgggggcactgacttaaatcccatcgcagagcttccaccagatcgacttccaccagatcgtattgtttgatgataactgtatgatccgcagtaaaaccttgattgacaaagcacccgcgcctgaaattgtaagaatatagaacctccggtacgattttgctggataagtgtatcgcgttttttaggcgggctgtatcgagatttcccattgtttccatgcggcaatacagcaggggatatacctggttcctatgggtggcttctacgaaatccatacattcacattttgtgatgttgttacttcctttccctgtcttcctgcggcaaaagccgatgacgctctttttttgattttgagtttgcttatccatccgtttgatctccgttttcttcgcatgatctccgtttttattttgtcacattgatgtccccattctttgtttccaaccctatttttacgtcagcgtcattgccaatcgttcccccagctgttttttcagtaatggataacaattccggaaaggacgtttgggtagtgccgttttgggttgtggcggtaaacgcaaaatgcaggctatctggaattaccagcgtaatgctgccgtttttggtgtatgcggataggtcgccggttacttccgcaaaagtaagctttaagctcccatctcctgttactttaaagtttccagagccaacgccttcgtccactgtcaaatctccgcctttcgatttgtattcaatcatgccggttatggaatccagccttgtatctgcattggtagtatcaattgcacaaacttgcgcggaaatattttttgccgtcagctttcctccggtgcttttaaaaacaattttgtcagcggtaaggttggaaacttcaagttcgccgttggtcgtatctgcgtggaaactgtctaatgtcagggcaacaccggataaaatgtttccgttcgttgtatgaatggaaaggctgtcctgataggcctccggcaaataaagctccatataggaatgcacgccgttcccgatgggacgcgcgccctcggatatggttagtacgcctcccactaaatctattttggcgaaatacgatttttgggttttatccatatactccacaacaacaattttgtcagaattacactctttcatggtcacgctttccccattataatcgaccataattgacttcacatcggtaagtgaaaactctttcgtttgggtgggaccctgcgagctggaacagccgccggataatgcagtaagacacagaagacttgccagtgcggcagcgatttgcgtttttgaaaacataataattcctcctataattgaatggttcatttaataaaatgggtatttttatacggggtctctctgcgccccgtataaatgatttatttcttgtaggcatataaaagattatccatacaaatctcttttgccacagaaacaggaatgttcttttgcgtttcaaatgcatcgttctggacgtgcatgccccaccaggctaaggtttcgacaatttgttgcgcagtcagctccgggtatttaaccgcccgcatttctccactgtgaagatagatcttgacgtagcgtaaaatattatcaaaaaagcttttacggtatctttgatagtagtctcccaatacgcccatatcgtttatgtttttttctaacacgagacagccggttccatatcgcgctattgtatcaaaagcgtcagaaatcatttgttcaaataaatatccgtctgcttctcttgataacggttcgctgaattttgcgtggctttcattcaggaccgtaataatttcttcggacagcctctcgaaaaaccgttcatcaatcggatattgaaattcctgctgtataaaatcagggtcaatggtacatttcaaaataaagtccaagatgtcctttttccccttaaaatatacatacagcatacctgttgataaaccaatctccttagcgatatctttcatttgagttctcatatatcccttgttgataaacaaagaacttgcggcttcatagattgtctgcagtctgttctccacgggtgccctccttttattgaactgttcattcaattacagtatacactgcttattagaaatgtcaagtacaccagatgttaatcgagaaaatttccttttgttgtggtttcaagggctgtgatagagcataacagtcccagctgtattcctcttgaccgcaatctcttttcgcgtgatcactccgcgcgattgcaggaagcttcggaagattgtcaaaaatacattcagacaattggttcgggcggtatgacagtaagattattattataaatgtccagctccgtaatccagcttcgatactgctcatatgcggccttctgggaaacgtaattctgctcttccgcaatgcattcctgtatgatcgtattctggctttctattctttctttcagggaactgcgcaggagatggttattctgtagagcagcggacacctcctcacggacatccgttttgtctgtcgagcaaaccaactgatcggatatgggacagacgggtttgtcaaggctggaaagtgtcgtatggaaaagcttaatattacgttcaatcaccatgagttcgcagttcatagccattcttctgctttctgcttctgcttttcgcgaacgggtatctatgaactggcggtcagacggctgagcaaccggcacctctccgatcagcttctgaagctcagtgatccgccgattctgaacagcgcgccgtttgaccgcctcttcgtactgattccattgttccaacacacaattcatacagttttgctgcatggttcgttctggcagcaggtttcggattactgacagcacgccctggcaggtgagcttccgaaataaaaccctggctcttccatatctgcgccgctgccccggagggcgccctgaaatccagccgcggttctgagggctgaccacagaggcgtctctgggaagcatggccagagacgcatagtctctttctgcttttattttcaggcgctgatccccgtattgttctgttgttttctgctgcctttttaatttctcggctttcgattcctttgccattttcagttctcctttttgagggttaaaagtatggatagacatactctgttgccggtttctccgctttgtcaatactctgtgctttcagcatcagggtctcgccgtccgcgctggcttcgagcgttccttttacgaccacccagtcgtcctccttaaaatccaaagttccgctgcagtctaccaggaagccgatcggtgataaatccgccgcgcagcaccacatagacagacgaaccaaagcgaaatcactgattttttctatctcagggtctttgtatataaatcctttcatcacgacggtgtagccctcatacttttcgtagaaggagctcagctcatacatccaggtatagtaatcttcgtctgcgattgtaatggtttttgtatcctcgtctaaaccgtttaagtcgtaccagggactttcgtcttcgctggcggctgtttcatcggctgtttcatcggctgtttcatcgacggatacatcgactgtttcatcggccgattcatcgacggattcatcagcgattccttctgtgattccttccgtgattccttccggggatcctgtgttttttgtggctgttctgttttcagacggtgtatcggtttctaaagcttcctggctgtctgccatggaatcctttttttcacttggcgtcgtctgatttcctctggcagacagaagcccgctgccatttcctgctgccatcgagatcccgggaccgtcgtaattttgaatcatactgcttcctcccggtgcagcaggacggacggcgagcagcagaatcggtataataaaaacgaaggagcgtgacaggtttgccttgtactgcggtgtcagcaggttccttccctccaatacagtccaaagaagcatcagagccgacattccgtagaggtacggcttcattctcggcgtcacatagttcagatactcgcccgagtatgtcaaacgaaaaagcagatatccaaaaatcagataacagcagcattccgtcagcacctggagattccagccttttcctttcagcatcatatccatatacctccgcttccgcacagcataaacagtgcgactacaatgaaacagacaagaaatgcggtcacggccagccggaccacaaacttcgaccgaaagcccgacagcagcatggcagcattcttaatgtccatcatcggtccgaataccagaaatccgatcagtggcccggcagggaggcttcctgccatacttctcgccaccaccgcgtcggaggatgagcagagggacagaataaaggccagccccatcatcagaagaagggctttccacggggcagacccgcttccggccaatacggcagaaggaatgaggtcctgaaacagcgttgatacaaaaataccggtgagaagatattttcccacggcaaagaactcgttctgcgcatgacggatcatcatggaaaaacgggccgcccgggtgttttcattaccggtgggaagactgtaatctccacagccggattgtaccggcacggcttcctccagcagataatcccccggtgtccggatcagataggtcagtccgcagatcaccgcgcacagaatccccagaccgcagcggaccgcaatcatccggtaattgccgttaaaggcataccaggtggagagaattaccacaggattaataaccggggataccagcataaaggttaccgcagcaggcagaggaacgcctttcttaaccagacttttaaagaccgggatggaggcgcagtcgcagactggcaggcagaagccagccagaatcgcaaacaactggcctgtcagaactttttccgggaaccttctctgaatccagtccggtggtatataaacctggatggcggaggaaagcaggactccgattgccagaaacggggctgcctgtaaaaatactccgagaaatatgctggcataacgcccaacaggaaccccgaaatctccgagcaggttaaacgcaaacagataagccaatgcagcagtcagaacaatcaggaaccagtgtcctggctgtgcgttgaagtgaaacatttcacggacaaatcgctcccatttccgctcggaaaacacccggatatccggattgcagttataaaggagcctggcgtctgttttgctatgtaagtgttttgtggctctgatgtaagcgcagtcgcttcctgcaatctgcgagaatgccgcggctccggcatcgggaatcctgtactgcagtccggcctcatccgccatatagattactttttccacgctcaccatcggtgcggctgaaaactggagcagcatttcctccagtttgtggaagtgctccatcccgttccattctaccagcattaaatccggattgtgctgttctaaatactccagaatccggtcggtaatactcatgggtaactgctccagctggctcttggagaacaccagcttttgaatctgtctgtcatttcggagcgcctcttccccggactcgaactggataaccaggacgtccagctcatgcagctcctcttccatcaacttgttaatcagtgttgtttttcccgaatccaataatccggttatgacccatgcgggtgtcctcatatcacaattcctcgctgaataatgtcttgatctgctgctcgtcaagccctgttccgataaaacaaagctggtttccttctatatttgcaggcactatctccaggctgcccggcataaaatgaaaaatcagactatgaggagaactttttacaattccctttcccctcagaatctctccatccgcctgctttacgacatgcagcaccttttttcgaagctgttcttctgaaagcggctccgtacactccagcgttactgccgaaaaaacctctctggcaaagtgacggtaaagaatcccttttttctgtttgctgtccttccggtatcccgttctgatccgaaccggcttcatggataccgtctgctccatacccagcttaaacagggcaatatttcgcggcccatactggaatacagggcgtggaatggaatcccagaagtccgcttcaattctggcttgcggattgatatccagaatacttttttttacccgtccgatttctttctgacactcctcctggtggctcagcaggattagatctgcataggatatctggtccttgaaaaactctccatagtttttcaaatacttatcaaagaaacggatatccaccacggtaatcgttcgttgaaggtgaaggtttcccttatcctcctgttttaagcatagtctggcgatgtcagaaagcttccccacgccggacggttccaccacaatggcgtccggcgcataatccttctgaatccgttccaaggctttttcaaaatcgccggtcaggctgcagcagatacagcctgcattcaagctggtgaccgtcaggctgcattcccggagcagccccgcgtcaatccccgcctccccgaaatcattttcaatgacaacgatcttcttatcccggaatacagaacgtaccatggttttaattaatgttgtcttacccgcgcctaaaaagccggatataatataaatatctgtcatttactctccttttccgccagccttcctatcgcggcaggccggcttcctgttttagctgacctccaatcctccggaacagcctttttcctgcaaataccagaagcaggaatatgacgccaactaaaacaatggttcctcccggttttaatcccagatagtaagcagcaaacagtccggtaatcataaaggtcacatcgagtcccaccgcccataaaacggtctggcggtaatttttaccgaactgcatggcgcaggccaccggaactaccatcatggaggacacaatcaacgctcccacggttctggctgcgacggaaaccgtcactgcgatcagaaaagtaaacagaaaatttaccgtccgcaccggcacgccggccagcctggcgctctgttcatccagggacacgtagaataattctttatacagcagcaggaacatcagaagcactgcggcgctgactgccaccacgagatgcagctccatatcactgattgccacgatgctgccaaacagaaagctgttaaagtttgctgcattctttacaaatccggacaggacgcctgccagccccactcctgcggacatgatgatggcaatggacatctcggaataacgcggcagcttcctgcgaatcagttcaattcccagggaggcggtgatacaggcaatcgctgctgctgccaccggatttatgcccagaatcagcccggccgcaactccggccagagaagtatgggacaacgcatcaccaatcatggacagccgtttaaacacaatgacaattccaatacagggaataacggccgcaagaaggattccgacaacaaaggcacgctgcataaagccgtaattaaagatctccatgagcgcattccccctctccggcccgtatcagttccatgcccccattctccaaaagccagatatcatctgcaaaggcttccagccgtttccggtcatgggtaaccatcagtaccgttaccccctgttccaggttaatcctctttaccagccggtaaaaatcctccgtgctccgttcatccattcccgttgccggttcatctaaaatcaacagcctgggttgactcaccagcgcccttgccagaaggattttctgctgctggccgccggacagccgtccaatcagccgctttgcataatcttccatcccaacctggagcagtgcctggcggacctggtctttttctctttttccggcaaaacgaaagagtccgatctgggcatataggtttgcctggacgatctcctccacagaggccgggaaattctgacaggatgccatgccgctctgggggacatagcttaagcacttccagtttttaaactgccggatatcgcatccgaagatagagattcccccatttttttcaccggaggatagttcccccagcaatagctttaacagagtgcttttccctgctccattttgccccagcagaaccgcaaagcggctctcgggaactgtaaaatcaatttgtttcaggacctgagtgcttccataagagaagttcagtcctctgactgcaatggcatccatcccgttatactccttgtctactacaatatatttatggttaatattccttacagccagtaaggacttatccatcttgttgcttaagctgttataatgatggagcaatcggtatatcggcttcctttcctggactttgcgtccgtaaaaacagactgataaccagctcctcattcgcagcgttcgttttatgcaggttgaactgcctccggtacgttcgtgtcacaccacagtagatggaataggcaatgagttaaactggtacttatccattgcagtaatcttaaggagtgacaagtttatgaatatgaacgcagtaggtattgatgtttccaaaggcaagagcatggttgctattcttcgcccttatggcgagattgtttcttcaccgtttgaaatcaaacatacatcttctaacatccaatctctgattgaacggattaaatctatcgaaggtaactcccgcatcgttatggagcatactggccgttattacgaaccacttgcccgtcagctttctctcgctggcctttttgtgactgctgtaaatcctaagctcattaaagatttcggaaataattctctccgtaaagtaaaatcggataaagctgatgctgtaaaaatagcccgttatacacttgacaactggattgatttgaaacagtatagtcttatggacgaactacgcaatcaattaaagactatgaaccgtcagtttgggttctatatgaaacacaaaacagctatgaagaataacctcatcggcattctcgatcagacttacccaggtgtaaatactttctttgatagccctgcccgtgaggacggcagccagaagtgggttgattttgccactacatactggcatgtggactgtgtccgtaaactgtcattaaacgcatttgtcggccattatcagaaatggtgcaaacgcaggatgtacaacttcagcaaagacaaggctgaagaaatctatggagctgccaaagagcttgttcctgtacttccgaaagatgatttaaccaagctgattgtgaaacaggccatagaacaattaaacactgcttccaagaccgtggaagaactccgtaccctgatgaatgaaactgcctctaagctgcctgaatatcccgttgtcatggaaatgaaaggcgttggcccatcacttggccctcagcttatggctgaaatcggagatgttacacgcttcactcataaaggagctatcaccgcatttgccggtgtggatccaggcgtaaatgaatcaggaacttatgaacagaaaagcgttccaatttccaagcgaggctcatcttcccttagaaagactttgttccaggtcatggactgtctcgtcaaaacaaagccgcaggatgaccctgtatatgcgtttattgacaagaaacgggctcagggaaaaccttactatgtctacatgaccgcaggtgctaataagtttctgcgtatctattacggaagagtaaaagaatatcttatgtctcttccagaataaagaatgccacaacctttcagaccagcggataacggtggtctatttgttgtacttgaaatttcatcaacaataactcttaaaaacttttcattatactattgactttttatttgcaggctgtcttttgtcatttttattcagcctctcttatttcagcgctgcctccagctgttttaagttctcctccattaccgagaagtagtcggcgccgctttccagttcctcatcgcttaagccttccagcggatttaacacctgtactgacgaaccggtttcctttgcaatggtttcggcaacctttgggcttaccagctcttcgaaaaagataaccctgacatgattggctcttacaaaatcgatgatctccgccattcttgcaggggagggctcagaatccggggacagtccctcgattcccacctgattgagaccgtaggcgtcacagagatagccgaaggcttcatgggataccacaatatccttgttcggcagggaagacagggtatctttaaatttctgatttaagtcagcgaacctggaggcgtacaattcgtagttggcttcatagtaatccctgttgtcaggatctgcttttatgtaggcattcttgatattttccatctctttttccgcattcagagggctgagccatacatggggatcatactgcccctcttcttccggttccccggcgccttcctcctcctcatggctgtggctgtggccgtctctaagcgccacccccttggaggcctccaccgatatcaggtctttgttatctaagctggccagcacatcgtccacccagtgctccattccggctccgctgtaaatgaacagatcggcttcttccagattcctgatatcggcagcagccggctcccagtcatggggttctgtgccggacggaaccagggtaatcacttccgccttgtcgccgccgattttggctgcaaagtcgtacatgggataaaagctggccataaccttcagcatttttttgctctccatggcatctgctttggctgccgggttcggcgcagcggctcttgtgcagccggatagcatggcagcggaaacaagcgctgtcatagccagcgcacgcagcattttaatcgaataaaatttcataaaataaatcctccagattgtggtttttagtcattcagcccttcgggcagagaaaaagggtacacaaaaacaaggcagatttcatgacaggcgtatcctgtcaagccatacacaaaaagtgaacggctaactgccttgcgtgaggatgattcaattatctaaacggatttttaagctgaccaaagataccgggcacagaaagagtccggtctgacagagtaataagatttttgaaatgacaagatatgcaaagatgacaactgctcctgttccaactgcttttgacaacagctgtattgtacatacgcaggcttcgatctccgcgcagacaaggcagtcttcacccgtacagtcatgctcagcatgtgtgacgataaaaagaccggagagaagcagcactgcggtcacaagaaacgcagcaagaaatgcatagagtcgtttgtttttattaaaatagttcacttcctctcctcctttccgtctcactggcattttcaatccagcatttttacattttatatattataacaacagttatgacattgtcaaggaagcattttcgcttccgctgctaatagggatacacatacccgtccaccggttccgccggcatgatatgggataccataatcagaggattggcatacttgtgtccgccatactcctcgtaggctgccgtaagcgttccctccaccgtcacccaggaatcttctttcaagtccgacgcacccggataactgcacatcaaaccagccggggctaaatcagccacacagcaggtcatggcaaggcgggcggctgcgaattcatctttcccgaaggactccggatcttttagtacatatccggttatgacaatcgtgtatcctgtatactgctccatgtgtaaatacagttcagaataccacatgccaaacaggtcatcagatattgtgatcttcttctccgccgcattcagcccgggcagctccgctccagtctcagttcgtgtactggttaatgaatccgccggtccatggaaaatcatgaacagaagaaacgggattatcagcaaaaagatcacctttttcaatttaaagttcgtttttcccgcattcagacttcctgtgtcaacataaacggggcttttcatagttctccttataaaaaagttctccctaatgttgtattctctgtttttagaatttatacacgtcctgctgaaacatagttctccctgttcctgcatactataaagagaaattttatgttgtgaggctttctatgaaccgtcttaagcgttatacactggctggaatcctttttgtttccgtgttcggtactctgtcacattttctctatcagctgtcaggaaacagttttctggtcggactgttcgctcccgtaggggagtctacctgggaacatatcaagctgttatttttcccgatgctgttctattctctgtggatgtcagttcgtcttcggaaagaagaacccggtgtcataccggcgctggcagtcggaaaccttgcgggctgtgtgctgatccccaccattttttacacatactcgggagtcctgggatttcatctgctttccctggatatcatcacctttctggtgagcgttctggccgccttcgcccttgccctgcgtctgactccaaatgggaaaattcgaaagtatgaacctgttcttgtggccgtaattgcgctgattgcagtgctgtttttcgttttcacatacggtccgccggaaatcggattatttgcagaaccgggaatctgaataaaagccgataaactcgtgaataatcacggtttatcggctttcttatcacaggaaatttagccattggtccagcgtccgcctcaactgttccaggttaatgggtttagccaggtgctcattcattccggcttccgccgtcttctgacggtcgtcggcaaaggcattcgcggtcatggctataatcggaatgtgtttggcatcatctctctctatggctcggattttccgggtcgaggtgcagccatccatcaccggcatctgcatatccataaaaatcagatcgtagtatccgggaggggattccatgaaacgttccagggcaactttcccgttttcagcgagttccaccgtaactcccagcattttcagcatttctgaggcaatttcctgattcagatcgttgtcttccaccaacaggattcgttttcccataaataatgagccggtctgcgtctgctcttccggctgagcggtgctttcgctgtccagaaactgcttcagcttcgaaaccaggcgggagcggaacagtggtttggtaataaagtcattggctcctgccgccgctgccctgtctacataggtcgaaaaatcataggcggatatcagaataatcggtatccggttccccaacgcctcccgcagcctctgtgtcgtctcgattccatccagctccggcattttcaggtccaggattaccgcaaagtaatcgcggccgctctcatgcatcgcagaggcccgttttatcgcctcctggccgtttaacacccattcacaccggatgccaagcgcttccaggcgggcgcaggtgttgatgcaggtgatttcatcgtcatctgccaccaggacagacagtcccctgagcgcttcgtcgtcagcgattccgtcgcttctccttaatatcaccgaggcggtaaacctgctgcctgcgccgtactcgctctccacctgtatgctgccgcccatcttttctgcaatgctcttacagatggcaaggcctaagccagtgccctgtacggcgtcgatctgcttctcatccgcccgttcaaacggctcaaagacacgcgtcagaaattcgctgtgcatcccgattccgttgtcctctaccacgaactcatagcagcttttctccggatcgtttgacggcttttcaaaaatctccagccggattaacccttccgtcggggtgtatttgattgcattggtcagcagattcatgatcagctgctggagccgctgcacatcaccaagcacagattcatgctctatatcgttgagatggatctgaaactgctgctgtttttcatcgaccagaggctgtaccatggataccacactgtgaatcagctccgccagatgaacctcctcctcagacagcgtgatcttaccgctctctactttggacatatccagaacttcattgataatactcaacagcagctttgccgaggaatcgatcttatcgagacagtccaccagacgctcctttatctctaaatgagctctcgcaatggacgacatccccatgattgcattcatgggggtacggatgtcatggctcatgcgggacagaaaatctgattttgcccggttggctttctctaaatctgctgttatctttttctctttttgaagcatctccattaaattcgactggaggctgatctcctccgacatatctgtgtaggtagcgtaatagatgcggcactccgcggttgactcccgcaggctcaaatcggatctgacccacacatacgtaccgtcaccgcggagcagccggtacttcttgacactgaaatgatcctttttgaacccctcctgataatcctgccgtacccattgattgtccgattccggaatattggcgaaaaaatcgtcaaaatactcactttccagaactgcggcgttacggtcaggaacaacggcgtcctccgcggtccggggaattctgaggatccggtacatccccagattggcgtacagcggttttgccctgccatccggatagagacgcacgagaatgacacccgatgaaatggaatccagcagatcgtatgcggcgtccgtccgtttctgcgacgccagaagtgatttttccagtttattctggtaatctccattgatctgttcataccgggttttcagcaggaagataccgatgatctgggcgatcgtcatgacgcattccctggtcttcgtgttgccttcccagtctgtacggaagcggacggagtcggacaggccaatgcaggcggccagacggccctgggcctgaatcggcgcctgaagtaacgaacgggtgccgagccgtttcagaatcgcagccgattcctcaggcagggtatccgtgctccagaaagcggtggtactgcccatggcgaaggcccccttctgtgcggccagcctcttctgattggtgtccttcctgttccaggcggaatccatgaagcctggtgcggtccagagataggtgttgataaactgactgtcggaaacggaatattccgatatgtagacactatcagctgaaaactcgtttcctactaatatcagcacgcggcggactgccgcgtcaaaatccgtttcgttccatagaatgtccaggatccgcgtttttaactggctgtaattatctgtattcatatgctcctccgcaggattctcttatcttctgtttcgagtcctggctcttcttatccttgtaacgggaaatgtcccggcagcacacaaggcatgcttccatccggttccactgtacaatcgaagcgtcagtcagaatccacattcccagaatatcgttgtacagctccatggtactctgcccggtctcaagggcttgtttaagcgcacagttttcgcagggactgtcccgcttataaaacacctcatagcagggccggccgggttctgcttccggcaccagttcctttgtctttcggttgaggtaacgcagggtgtaggtatccggatccaggacatacagccatacctcctgctgatccagaacactgtgcaggttcagcacggattcactcagggcatcctgcgtccggtacttgagcaggaacacggacagcagcttgcctgtaaaggtcagcgcctcgatctgctccctggtccagaagcggcggattccgcagtcatcaaagcctaccagaccgtagaaggtaccattttcccgtatggcgtactgcagggtggacagcactgcccgcccctccagaaatcccttttcccggtccgccagtttgctgatattctgacagtaaaagagtccgtcttcaccaaagttctcccggtaatcaaagccgttactcacatagggaacctgctggaggtaatggatctgcggctcgatgccttcggcgcaccactcaaaggtgttgttgcagcgccgcccatctttgctgctttcaatgatataagtccggctgatttcaaacatctccccgatcagggccagaatggactgcaccgccctcccgaaatcctcagcgccgtataaaatatcaaacgccctcgaaatcagggtgggaagattccactgcttcaaacggtccgaatcaatctccgtgcggcagacagccgcttccgcctccggtctgccgataagcccattccgcatctcatcctgatagcagaccgcctgctttttgcctgctgccttggccctgtaaagggcacggtcggcgtgttcgaataaatcccggaagttcaaggcaccgcccctggcaaaggccaggccgacactgcacgaaaaggccatatctctcatgttttcatgaagcagatccttcagaaccgaaaggatctcctctgcacgctgctctgccacctcttccttacggacgtttggcataaagatcagaaattcatcgccgccgatccgcgcgaccgtatcctggccgcggaacagcttcgccacatttgaggagagctcgaccagtaccgcgtccccgaacatgtggccgtatcggtcgttgatctgtttaaaatcatccacatccagaatcatcagggccgacaggtcatcgggagcgcaggccgaaaagtgtgcttctatcctgccttgggcagaaaccttgttatagaggccggtgagcacatcgcgtgccgcccggtcctccagggacgctttctctgccttctgtgaatcgatatccacgatcaccccgacggccttaaatggcttgttgtcaatatcaaactgagcggtggcgcgcaccagcctccagcgatagacgccggctccatccgcaatgcggaattcggcttccttataggggatgccgattctcatggtctgcatcagatcctgaaataccggaacatcgtccggatggatgtgcgatattctggggatctcactgctcacattctttgtaataggctggtaaccgtactgactcttccatttgggggagagatacagttcatcgtttcggatatcccattcaaaaataatatcattcgtctgttccataatgatattgtgccgttccagggacagacgcagctcctcctccgcctgatggtggcgggctgcatccagaattacgcaatacgcaacctcagcaccattctccaccgtgatgagacagtgatcggatacccagaccgtatggccatcctttgccacaagacggtattcgagttgcaaaatctttccctcgttgcgctgttccttaaactgctttgccagcttctcccggtcagggggatatacgagttccatcagatggttttgaaactgcgtttcgatctcgcgttcggaataatgcagcagattcacgaggctgtggctgatttggatcagtgtaaaatgctgatcgcaccggcacttctgaatgccgcctaagagcaggtcggccgccggataagcgaccggcagcggttcgaaaggagccggatggcctggctgatccgtctgcggaaattcttccttgcgccacaccagcagtacccggtgctgacggggattctccagattgatacgaagcagagaggctctgcaccagacgtatgtatccctgctgcggtccaggatccggtacttccggtcgcggcaggtcagtccttcgtcgaaaagctccctgatataattatccagcagggctaatacctgcgcacggtcttcgggatgaaccgccgcttccgtaaaattgcggatggcgtcctcgaaacggttcccagaccgcagcgcggaaaaatcctgatccgctaagtagaccagatgatagacaccggtatcgtaatccagttccatgaccgttgaatccatatggcgcagcagggtgaaatatttaagctggctctgttccagtgtgttgtctcccgtatcatagagggaggcggacggaatatgcggagccgtcttgatcttgccgggcagatggtcggcatactctgcggaaagctgagcaaatttatccctcacatttttgaagcattccagaagccgcggagaaaatttcccgcattctccattcagaatcatactgaaggcctggctgggggcgatggcttttttatacacgcggtctgtcgtgagcgcatcgtagcagtccgcgatggccaccacctgtgcgcagatggggatgctgtcccctttcaagccatccggatacccgtttccatcccatctctcgtgatgatagcggcagatccggtaggcatattcaaaatactcctgatcccgcagactgtccaggtctgtgagaagctcgcagcctttcatcgtatgggtcttcatgacttcgaattcttcatatgtcagcttcccgggcttgttgagaatactgtcgggaatggcaatcttaccgatgtcgtgcagggaagaggcctccataataagctggatcttccggctgtccaggttgtagacctggtagttctccgccacgtcctccagcagaatctgtgtgaacatccggatgcggcggatatgctgaccggattcaaggctgcggtattcgatgaccgaggtgagcatatcgatcaccgcggcattggcctcccgtgtgcgggcggactgttccgcgaccatcgtctccagctgccgcctgtagcggcccagttcaataatatttttaacacggtttttaatttcagcgggatcgaagggcttggcgatgacatcggatgcgcccagttcaaataccctggcgcggtttcccatgctgtcatccgccgtgatcacgatgaccggtgagtggtaaagaaaacggttctcctgcatctcctttaatacctcgtagccatctttttccggcatgacgagatcgaggagaaccacggtgattcgttcgcggtactgccgcagcaggatcagggcctgctctccgttctctgcctccagcaggttgtattcatcctcgaataagtttcttaatatagcccggttgagatctgcatcatctgcaattaaaatagtttctttcccgtccaaaggatcacctcactttttctccgctgacatatcatataaataattattataaagcataaccgaaaaaaactcaaccacatatggacagagtaaacggcgcgtgaaacaggcaaataaaaccggcaaatgaaaccggcaagtgaaaccggcagcaggcgggacatatacgcatgaaatagaaaaacggactccgaagagtccgctgtttgtaatcctgattctatggcaggaagatgaaggaatccccatccatccttttttgttcctttctatgacagcatctgcgacaccaccggacgcagccttgcagccagcataatggcaagaatgcacagcaggccatccggaaacatggtaggcagacaatagactgcgaaaatcgccgcccagcctacggtgttcggtgtaacgactataaaatgtgtaataaagtaaaaatataagattcccgttccataataaatgacgtaaccgatcgccgccgcaaggatccaggtcctgatctttgacgaatgcaggatctcacatacctttcccatcgcataggccgcaaaggcaaagcccagcagaaagccgaaggtcggccggattaaataggcagggccgccgccgcgcgcaaaaaccggaaatcctaccaatccaatgaccagatacgttgtgacactgtaaaatgcccgcttcgatcccagcagaagacctgccagaagcacgaaaagccattgaagtgtgaaattcatcgtatccacgccaaccggaattacaatctttaaaaaggcccctaccgcaattaacgaggcaaaaagaccacaaatcgccatatccttcgtcagttctcttctttgagctatcactccatttttctctctcatctgtatcctcacctttctgtctcaactttcgcaagtgctcatgatgattgtacactttttttataaattttacaatctttttttagacggactgcggtgtgaaacgtaggcgtgtaccgcagcgtcacagccgcagccccttgatatccttgatccgggacagaatcatgttgcagctgctgctgagtactccgggaagcgggtctatcacttcctcgatcagctgttccatctcctctcccgacgcggcgaccgcgtggacatggagcttgttctttccggtgacacggtagatctgggtgatggtctcgttccggcgcagtgtccctgttacctgggccagtgtgtccgggcttgtctcaatctcaaagtagcaggatacggctccgctgatcttctggggattgataatggtggtatactcttcgatcacgccccgtttttccagcgactggacccgcatcttgacggccacccgtgagataccgaccaggctgcctatttccgaataggacatgcgggcatttttaatcaacagctgtacaatcttctgatccaattcatccaggccttcaagaaacatgttatctccttcttttacgatcgtttttcacggtcatagatacaattatttcaccagttactctcctgatattataaaatcatttgctgcaaaaggcaatctattaattgacacgcgctcttttaaccgatataatagttacgaagcgtaagttataaattacatatagaaaggttttgcgcgatgatgaaaggtgatttaacacaggggccggtgatgaaaaccatgcttctctttgcggttcccatgattttaggcaatcttttacagcagtgctataatgtggcggatactctcattgtgggccgtttcctcgggccggacgcactggctgcggtgggatccgcatttaccctgatgacttttctgacctcaatcctgctgggactctgtatgggaagcagcgccgtcttttcgatccggtttgggcagaaggattttgacgggctgaaagaaagtatctttacctccttccttctcattgcggtaatcagtatcctcctgaatctgctggccttttggagtgcggatctgatccttgtttttttaagagtgccggaggaaatacgggggatgatgcgggagtacctgattgtcatattctgcggtatcatggctgtgtttctctataactatttttcctgtctcctgcgcgccattggtaattccgtcacgcctctgctgtttttagctgtttccgccgtgctgaatatcgctctggacctctggtttgtgctgggacttcaccgcggtgtcgccggagccgctgaagccaccgtaatctcccagtacgtttcgggaattggaattgccgtctattcctggttttcctgcccgtggctgcgtatcgggaaagaacacatgagaatccgccgctcctgcttaaaagagattgccggattttccgtgctgacgtgtgtccagcagtccgtcatgaatctcggcatcctgatggtgcagggtcttgtcaacagctttggtacaacagtgatggcggcatttgcggtcgccgtgaagattgattcctttgcctatatgccggtacaggactttggcaacgccttctcctcctttattgcccagaattttggcgcaggaaggaaggaccggattcagaccggatttaagggagcggtcctcgtctcctttctgttctgccttgcgatttccgcgattatctggatctttgcgcgtccgctgatgcttctgtttgtcagtgaacgggagacggctattattgcggaaggaatgcggtaccttcatattgagggggctttttactgcggaatcggctgtctgtttctgctctatggactttaccgtgcgctgggaaagccaggcatgtccgtggtgctcacggtcatctccctgggaacccgcgtcctgctcgcctatgttctgtcttccattccggcgatcggcgtggttggaatctggtggtcggtgcccattgggtggtttctggcggacgcggttgggttggggtactttatccggtacagacggcggctgctatagaagtgccggccaggacgttgtagaaagggcattataggtattacgtgcattacggggattatgggtattatgggcattataaaaagatgaagtatggatcacagggtccggacttcatctttttattttatgctttgggcgttcacgtttctttgtattttcgattccttactgcttttacaggctcataccagagtacagaaacggcagcgatgcagagtgctgtaaagaattggagcagggataagggcgccagcttcaaaaatgaatgaatcgggctgtaaaggctgactcccagaagcagcaatgtcataaaggcggccagacgcatgacgcggtcccgcgccagtttcttcgcggagcaccaggcgctgtcgcactcggaagcattgaccagcacaaggaacagattgcccaggatcacgatggaaagccccatggagcgcgcctgcggggcagattccccctgactgagcgtcaggtaatagcttccgaaggaggtgccgaaaaggacaagcccctgcacgatacttttcgtcagagaggaaaggcgcagcagcttttccgatcgtttccgcggcggtctgcacatgacgcacgattctgcgggctgccgctccaggatcacggagcaggtcggatcaatcatcagttccattaatacgatgtgtacaggcagaaacatgagcgcagaaggtgcgatccccagcatggaggccgacagggaggccagggcaatggggatatggatggtgaagatatatcccactgcttttcggatattgtcgtagatccgccgtccatcccgcacggtctcgacaatggtgtgaaagttatcatccatcaggattaagtctgcggcctccctggatacctcacttccccgttttcccatagcgattccaatgtccgcatatttcagcgcaggcgcatcattgactccgtccccggtcatggcgacgatctccccgctatccttcaaagccttgacaatccgcattttgtgctcgggaatgacccgcgcgaagatcgataccgactttacggtctgcagcagctcttcctctgtcatgcggtccagcatctcaccggtgacactgccgctctcccagtcgatgccggtctgcgcggcgatggccgccgcagttaagccgctgtctccggtgatcatgacgatacggatacctgccctccggcagagggcaatatcttcccttatgccttccctcggcggatcataaagtcctgcaagcccggaaaacaggaggccgcatccagccagagagtccgggacattttcatccgggggcagggccgcagacgccatggcgatgacacggagtccttctccggacagctccgcgaccttctcttccactgccttccgctcatcttcagagagggaacagagttcgagaatggcttccggagaccccttggcagctacgaggcgttccccatccagctcccagacatgccccattcgcctggattcgttggtaaatgcatactcctgaataagcgtgccgcgaaagagatcatcctttgtaactccagacttctcacagtattccagcatggctttctccatggggtcataggcgtcggtctcgcaggccagccccataaggaataccagcccgctgtccctggcggcctcgggccacaacgttttcacttccatatggttcttcgtgatggttccggtcttatccacacagaggacagagacggctcccagagtctcgaccgaaggcagatgacgcaccagagagtgcttcttagccagccgccatgctcccatggagagaaagacggtgagaaccacgggaaattcctccggtatcatggccatggccagggtgactcccgacaaaatgcttttgatcaggcgttcctggaagggataaccggccagattgatgtacgtgaaggcgctgacgaggagaaacaacagcgctgcgattcccgcacagacggtgaccaggctcttcgtctgcttctgaagcggagtcatcaccttttccgcttccagaacgtggcttcccgcctttccgtattccgtggccgcacctgtcttttccaccagaacataagcatttccctgtacggccagggtgcctgcgtagcagaaatcgtgtttccagtagccttcgctgttctccggttccagggacggatcgggattggacgaccgggcatgcttccagacacggaccggttcaccggtaagcgttgattcatcgacacagaaatcgctgcaggatacgatggagccgtcggccggaatcttgatgccctcgcagagcaccatgatatccccgggtaccagctccgcgctggcaatctcctgtctgacaccgtcgcggatcaccgttactcgcggagcagacaaatccctgagcgcacgcagcgtgcggtcggtcttccattcctgggccacatcaatggtgatcatacaggtgacaaacaggagcatcactgctccatcccgcggctctcctaagatgaagtagatcaccgaagcgatcatcaaaaggagaaacatgggttccgccataacgtggagtgctttcttaaaaaaactttctttcttttgcggagtcagttcatttcttccgtacttttcgagaagcttttgtgccccggcggttgtcagaccttccggcatcccattgttccaagtctccataaggaacctcccataatagattacgacaaaaaaggcgcacctgtggaacatactactgtcccacagatgcgcctgatacccatctgctgccgtctcgacggcccggcttcatgtcatttacagacattgcctgctcagtttgtactgttgatcccgcatcctttcagatggaatgcagtgcaaagagattatctgatgttattttatgatggaggtgagaaagatgtgacaaaggatttgtcaagaggatcgaatgcaggattacaacaagaaagagtccggcgagccggactctcgcgccgaagcgcggtcgcttcagcggccatacttccttggcgcggagtgcgcatcctcctggaggttttttatttcataggacgaactttcctgtaaaaaaataaaaaacgacagaggataccgcacaacgcggtacactctgtcgttctttttaaatttcagaaaaccaggcagcccgattctaacgaaacgaattataaaagtctttcaaatccgcctttgtttccgcgtcaagctccgttttctttatgccgagtatggctccctccagcgaatagagacgatgaatgcaggcggagtcatcgatggccttgatacgcagccaggcctgacggcttccgatctccttaagttcttcataagtcgtgataccgacctgatttaactgttcctccactactttgccgatattcggcagcttcgccagttctcccataaagaatcctcctttagcgttctgcgaatttttctacaatctttagcagaagctcaaccactttttccatggactgtaccggaataaactcatacttaccgtggaaattatagcctccggtgcagagattcggacacggaagacccatgtaggaaagacgggcgccgtcggtgcctccgcggatcggagttacgatcggttcgatgccgatctcttccatcgccgctttggcaatgtcgatcagatagatattcggctcgatgatttctttcatgttgcggtagctttccttgagttccagattcacggtgccttttccgtatctgtcatttaagtaggcggcaacacgcgtgataaactctttcttctccgcaaactttttctcgtcaaaatcgcggatgatgtagtctaaatgagcctcttccacggtaccgcgcatggaatccagatggaaaaatccttcatagccttctgtatacatgggattttcaaagaccggaagcatgttgtggaactccatggccatgagtatcgcattcctcatctttcctttggaggagcctggatgaatgctggagccgtggatatccaccttcgcggaggctgcattgaagttctcatattccaattcgcctaatcctccgccatccacggtataggcggcatctgcggcgaatcctgccacatcgaataaatctgctccgtgtcccacttcctcatccggtgtgaagccaatgcggatcgttccgtggggaatctccgggtgagccagaagatactctgccatggtcatgatttctgcgacaccggccttgtcgtccgcaccaagcagtgtggtgccgtccgtggtgacaatgtcctgtcccttatactttaacagatccgggaaatcggctgtcttcatggtgagaccggtctcctgattcatcaggatgtctccgccgtcatactgttttacaatctgcgggtgtacattggcaccggagtaagccggagccgtatccatatgagcgataaagccgattaccggaaccttcttgtccatggtggccggtatggtggcatatacgtatgagttctgatccacgcgcacgtcctgtgcatgcatggcgcgcagttcttccgccagaacctccgctaagacacgctggctttccgtgctcggaaattcttccacgtcttccttcgattcggtatcgtaggaaacatactttaaaaagtgatttaaaacttctgacatgattcatgtcctcctttgagctatagatctctgtatcgttgtgataagtatctgacggtttctgtcccttcagaccttcttctctcaattttctaattataacataaacacgaacagggtgaaagcccctattatgtgtttcctggtctgactaatcccgcctgctgtctgctaattctgccctcacagcttctggaaatacgtagtcccatgaaagctgcaaagcagggttatccagcatgtcgcgatagggggcaatttcattttcccactgttccttcgtacaggaatcaccgtccatcgtataggtattcttgtcagggtcgccgtccaccgcaaattccacgaggaaatcacgggattcggaatcgataaggaaaccgtcaaaatccagtcttcgatagtaatagcagtcgtagctgagaccggttgccttataaccgatcattccgccgtccttcaatggagtcaaaggcctggcatatctgtcagagcttcggagcagggcgagctttccgctgcggcatgtatagatattatagaaataaccgcccacgatatgcagctccgggaccccgtctccattgcagtctccgaaggcataaacggcattcccatctcccagtggatagtcggccgtagccgtaagggaatacatggtatcatcctttaaaagttcgcggtacaggctgactgcggtctcaggagaagtctgctgggaatggatttcttcttcgctggctgccgctgtctcagggcttactactgccttttcatatatgtcagccagttcctccggcgtatagacgaattcgatcacatctgtcataaggatttgatccctgagacggtcgtagcgatagcagactccatctataagaataccttccgtcagcgtctgctccagtatgtcagtctctcctatgatgatgggaggaacgcagtaatcttcctccaagctggtataataaataaagtgactggtgaaaaaataattgctctccatgcgaccggtctcaccataaagaaccagtcggtaccggtatattttcccccctttatccgtataacgggtaatggttccgccctccgtgctgagatccacgaaatctcttgtactgcctttgatattgatgacaaacgaatcggttggctcatcgtaatagacgctggatcggtattggctcataaaggtgctgatctgtgcggcaatcttgccgcaggtatcgggaatggagggctggttggctgatgacgactctgatggctcaaatgtttcagatggttccgatgtcgcagaatcgtctgtggttacgggcatggtggcagacatgctttctgtctgtaaagtttcctcacccatgcccggagcctgtctgcacgatataagtaagatgaagatcaacggaaacagaaaacaggccagtgcatacttacaggccagtgcatactttcttcttcgtgacattttattctcacctgctctttctgcattttgctttttctgcatttatagggaatagagctgactttgtatattgatacgatatgatatagcgaaacaatatcatatacagcaacagtatcatatacaacaacagtatcatatacagtaacagtatcataccccacataaaaagtcactgtttacatgaacagattttatctttgcagccctcatttttcaccacaaaaaatcctttaaaagaaaatagcatttatcttctctcaaaggatttttctatacagattaacataaaattattatgtcaactcatcgcctctatcttatttcttacttacctgtttgccagttcccgcgtaatatcttcccaggttacacccttatccgccatcaataccatcatgtggtacaggaagtcggaaatctcatacttcacttcctccgggtcaggatttttagccgcaatcacaatctctgtcgcttcctcgcccagcttcttcaggatcttatcgattcccttgtcgaacagataattggtataggaaccctccttcggattctccttgcggtcgagaataatggcgaaaacgtcttcaaatacctttaaaggattcgtctcctgatactccttctttaccagcgtctggaagaagcagctgcgcgctcccgtatggcaggccgcgccgatctgattgacctttgccaacagggtatcgttgtcgcagtctaaggagagagacttcacatactggtaatggccggaggtctcacccttcagccagagactctggcggcttctgctgaaatacgtcatgaggccgctgtgaagcgtcgcctcaaaggcttcctgattcatataggccatcataagaacctcggaggtccggtaatcctggacgatcacggggatcagtccgtcggagttcagcttaaagtcttcccacgccaccgcactttcaaaggtatcaactgcaataccgttcttctttaactgctgctttaattccatgcaggaaggtgattttccggtcatggaaccgatgacgccggatacacggccagaagccaacatagcggaaaatacagccgcatcaggacaatcagatgagaggataaacgtctcttccttctcctccagctgcgcggtctccgcttccgacggacaggcacatccgagaatcatgacggaagcgccaagctggctgtattccgcagtccgttccagccaggtgaaatccggcagccaggcgtagatcttatcatcaccgaaacggtcggaggcctccttcatcaagtcgacattttcatctacatctacattgagaaatacggcctttgcacctgcgtagaggtatttcttcacatcctccagacgtctgacgcggcctcctgttataatggggacatcggccgttctggcgatttccttgatcagtccgatggtacgctcgtgatcctcatccgtttcggacagatcatagaggaacagttcatcggcgccgctgtcaccgtaataccgggaaagcgcgaggacatcattctcacagcagtctgcaccccacagtgcggccgcctttccctcgcggataccgaatcccggaatcacctttttatattcgttcataacatcattctccttccgcaccactgtcattcgaatgcttccaccgcttcttttagattaattctgttttcatacagagcttttccaataattgctccctttacaccagcctcatgaaggcgtctcaaatcgtccatggaagacattcctccggaagcgatgatgtccatgccggttgcctctgtcagggcctttgtggcctccacattggggccggtgagcatgccgtctctggaaatatcggtataaaccacatggcggacgccgtattccttcatctgaccgcatagatccgatgccgttatttcgctgaccttctcccagccttcgatggctaccagcccatttttcgcatccacaccggctacgatccggtctgcgccgaaatgggtaactgcgtcgcgaaggaaaaggggattttggaccgcctttgtcccgatgattacgcggctgacgcccaaattcagcatacgctcgatggcctcctctgtccggattccgccgccgatctcgatcggcttggagaaggctgcgacgatccgtctgatggcgtcttcattgaccgaatagcctgccagcgcgccatccaaatccaccagatgcaggaatgtggccccctgtgattcccagtatgccgccaccttctccggagaatcggaataaacggtgatctctttgaattttccctgttttaagcggacacactgtccgtttttcatgtcaatagccggatataactgcataatattctccttcttcccggtttacagtgtcccttttgtcgacaacacatccgtgattctcgggtccgtctgtgtggcctcgtcgagagccttggcaaatgccttgaagatgccctcaatgatatgatggttattctccccggacagctttctgatatgaagattcatttccgccgcataggaaacggcgtagaagaactcctttaccatctcggtctcaagctgcccgactctctcggctgtaaaggccgcgtcgaaaacgaagtaggggcggcccgataaatcgatggcacagagaatcagagactcatccatgggaagaatcatatttccataccgtttaagcgatttcttattgccaaccgcctctttgatggcggtgcccagcacgatgcccgtatcctcgatcgtatggtgggtatcgacctccaaatcgcccttcacttccacgtccagatcaaacaggccgtggcgggcaaagctgttcagcatatgatcaaagaagccgattcccgtctgaacagaagcgctgcccgatccgtccaggttcagcttcaggcggatatccgtctctttcgtcactctcgttatttccgcagttcttcccatatcctcgtcctctcttctctatttttcaaatctgaccctgacagaattggcatgtgcggtcagctgctccgcctctgcaaacgcctcgatatcctcatgaatggcctccagagcgtctttggaatagtaaatgatgctggatttcttcacgaagtcgtctacgttcagcggggagaagaactttgctgttccgttggtcggaagcacgtggttcgggcctgcgaagtagtcgccaagaggctcagaactgtattccccgatgaagatggctcccgcatttttcacacgagtcatgtcttcaaatgggttcttcgtcacgatctccaaatgctccggagcgatctcattgaccgtttccagggcgtccgccatggtgtctgccaccaggatgtagccgtaattatccagcgatttctgaatgatctctgagcgggaaagctcctttgtgaaccgcttcgcctcttccgataccttctttgccaggtccatgctggtggtaaccagaatggcagaggccagttcatcgtgttccgcctgagataagagatccgccgctacaaaacggggattggcactttcatcggccaggaccagaatttcgctgggaccggcgatgctgtcgatgctgacatggccgtataccgccttcttggccagcgccacgaagatattgccggggcctacgatcttattgacccgcgggatggattcggtaccaaacgccagtgccgcgatggcctgggcgccgcccactttatagacctcggtcgcccctgcaagatgcgccgcggtgagggtcacgggattgacctttccgtctctgcccggaggggttaccatgacgatcttctcgactccggccacctcggcgggaatgatgttcatgagaacggaggacggataagccgccttgccgccgggaacgtagacgccgacactggaaagcgctgtgatcttctggcccagtatcgttccatccggcttgctgtcaaaccagctgtacgtcttctgcttctcgtggaaggcccggatattcttcatggagcgcttcatgacctccaaaagtcccggttccacctctctcatggcctcttcaatctcctctttggtcacccggatggtggaggcgtctatcacggcatggtcaaactgctctgtataggaaaatacagccgcgtcgcggtcacgttttactgtgtccacgatctcctggaccgtatctgaataggcggtataattgttcggatcacgctttaataagtctgcgagaatatcctttttggaagtttcgtctaacgcaacaattctcatttgttttcctccttgtagtgagcgttttaaaacatcagcccatcgactgcattaaattcctcaaatcatggatcagacgggtaatccggtcgttttcccgcttcatgctgacttggttgactaccatgcgggcagacagcggacagatctcttccagcacagttaagccgttttccttgagcgtcgtgcccgtctccacaatgtccacgatgacctcggagaggccgacgatgggggcaagctcaatggagccgttcagcttgataatctccacggtctggtgctttttattgtaaaagtaatcctttgcaatggccggatatttggtggccacacggattctctcgtgatgctttaacagctcttctgcctctttcggtccgcagacacacatacggcagttacccagccctaagttcatcacctcatagagcttccggccctcttccaggatggtgtcctttccgaccacgccgatgtcggcggcgccgtactccacgtaggtcggcacatcgcttgccttggccaggaagaaacgcatccccagctcctcgtttgtaaagatcagcttccgggagctcttatcccgcatctcttcacatgtgattccgattttttccagcagatccagcgactgttctgccagacggccctttgccagggcaaatgtcaaatatctcatgtcatccctcattttaagtattcggacagcggtatctcgtccatccggtctaagttcaagttcacgatctttacggaaaagcccttctcatctaagtacagcaggttcgtaatggtggtgcgccccgcataggctttatacgcctccagcgtcttgtccgccttcttaagctgaagctgcaccggcatggaggtatcgcggaagtgcttcgcaagctggatcgcctgctctctggattccggctcgaagagaatcatggtattgaccacccggaccggcgtatcgatcttctgtctggataaagccagcatcagatcatcgacggagattccgaagcccacggccggtgcatcctttccgaactggacgagaagcttgtcgtaccgcccgccgtttacgatgtaatctccggttccgtaagtataggccttgaaaatgattccggtgtaatactggtactggctcagcattccaaggtcatacgaaacgtattccgacaaatcgtaatattccagaatccgattcacctcttccagacggtcaatcgcccgtaaggcccgcgggtttttcgtaaactctctggcggcctggatctcctccagggaaccgaacagttcaggaagctttagaaatgcatcctttaattcctgtggaatgggctgttccatcaccagctcctccacgccgaaataattcttgttctcgatcagctcacgaagcttctcctccatctcctcgtccatgccggcttcctctagaaggccgcggaagaaatcgacctctcccagctccacctggaattccgtgaggccagccgccttcagggcccggataaccatggcgagaatctccgcatccgcgtcggacgagtcatcaccgatcagttccacaccggtctgggccgcttccttgagccgtccctggtagctggtgttattgataaaggtccgctccaaatagcagagccgcaaaggcatatcctcttctgtaaaatacttcgtcacacatctggcgatcgccggcgtctcatcgggccggagcaccagggtatggttatccctgtcgaaaaacttaaacatctctttcgctttaacgcttccgcgggattcattaaagatatcaaagaattcaaaggtcggcgtttcaatgtcctgatatccgtacagatggaatatctctaagatcctgttctgaatggctgcctttcgggtgcattccactccgtagatgtcccggacgccatccggtgtatgtaataatttgtttgccatagcttcctccgaacgttgctgcatactgctttcatatggtaaagtgctaccatgataacgtgtagtttattataagggacactgcccgacttgtcaatctcttctgtccaaatctttctgaatcatctccagatagtggacaaagatatcccggcagctgcgtatctgccaggacttatccacttcctcataggtgaagcttttgcgcccgccctcctccattcgagtccagaatcgaaggatttcgtcgaacggaagataatatatctcatttttcaccgtataggacaggatgatgaaggagatgcctccctgctcctcgaattcacgcataaaggcaatctgatgcgggtggatattgtgcaggggaaacgtctccacggcgcactccttggcgtcaaaacagacgggaatcccctgtacggccccgatgtagtctaccgtactcttttgatcaaaataagccagcgtgatgtggcggctctccttatcgatggagatgggggtgatcggggtcggcaccttctggatcagggccagtttcttctcacggtagctgtcgttgctgcggttgatgatatcttccagtgcggagcctcttaagcccctcgtgttccatgttcccatagcctaactccaatcccggcagattttccggaaggtctgcgggagcggcgctgaaaaggttttgccggaaagaccggtcagcggttccggcagctgcggaaatgtcaccgtacaggaatgaagcatctgggaacggatattccagcgctttttcgcctcttcattgaccgagctgtcaccgtatttgtagtccccaagaatgggatggccgatagaggccagatgcgcccggatctgatgggtccgccctgtaatcagcttgacgcttaacagcgtgcagtcctccgcccagccgagcggttcatattccgtcataatgggaacgcttcccgccgtttccgttgtggtgacggtcacctggttcgtggcctcgtcctttttaagaaatccggtaatgacctgtttttccgtcacacggccctttaccacgcaccggtagtatttatgcaggcttctgtctttgaagaccgcggacataatctgaaggcccggcagagacttgccggcgacgacgaggccgctggtgtttctgtccaggcggttgcagacggatgggcggaagctctggagctgttctgtggataactgtccgctggatatgaggtaatcgatgatgtattccaccagggattcatcggtgtccttcgctttctgggaaagcattcccgaaggcttgttgaccagaagaatatggtcatcctcataaatgatatgcagattcacctttttgacctcctggagcgtatgagaggaaaacttctcaatggtctcctcggagaagaacagcttgacctcgtctccctggacgagcttctccgagccatcacattttttcccattcagcgtgatgttcttcttgcgcatcatcttatagagaaatcccttaccggccagatttaagtatttggccagcagcttgtcgagccgctgacccgattcattttcagaaacaatgagagaacgcatctttcaattccccttacatggatagatttttaagcagctggagcgtgtagtccacactgccgtcatcctcgtattcttccgccggcttcaggctctccatccggtggaaaaatgccttttcatcgagaatgatcttcacgctaagatccagcttgtgtcccgcaaacatctcttttaagaatttctccgcttttgcagtgtccagcttcggcgaggtacagtataggaatacgccgctgggatggacaatggctgcatccgccgggatgatagcgtctctggtggtgatgattaagtcgtacagaatggaaaaatgtccctcataccctgccgctctccggtgaaagtcctcggatggcgtcttataacgccaggccgcgagaagcggtgaggccacgttggccgtgggaagaacggaaaggatggccatgaccgtcagaatattcttccaggccgtgttgtccacaaaatatcttgcgatcagctgggcgataatcatggctgctccgaaggcgactttgcctgtctccactttcttatgatggttccggtatccgtactgccccttgttgtattttttcacagttgtcattccttttttatcggtatagtgttgattcaatccccgtttgttatagtgccttcatgattcttaagatcatgccgtgaggcagaaccttgcagagcagatgaaatgccttcatggtaatgccgtagaccgacacggtccgtcccatcatattgtcgcggatcgctttctttactacgcgcttcggatccgccatgacgatcctcttatagaccggaatctcgcccgtggtctccgcaatatcgaagaattccgtcttgactggtccggggcatactgcggtcacatagatgccacgcggttttaactcctcgttaagcgcccggctgtagctgagtacgaaggacttcgtggccgcgtagatggcaaaatccggctgcggaagaaatgctgccgaggaagccagctgaatgatgcggctgttcccggagaggtagggaagcaccatatgcgtgactacgcagagcgctttgcagtttaaatccaccataccggcttcatcggcaagatttaaagaacctaccggtccaatctttccgaagcccgccgagttgatcagccatttgacatcggggtgctcttcctccagcgtgcactgaaaatccatcagttccttatggtctgttaaatccacggcgaagatgcgcaaacgcactggaaccgtggataccagctccttcagccggtcttcgcgtctggcgataacccagatttcatcgattccgttaaaacggtccgccagctgcctgacaaattctctgcccattcctgaggaggcccctgttacaactgcaatcttcatttgaatcccttcttttctcttttattttttaacctttttatgaacgtttcttatggtctttttctttcccgccggtttgtcgtcccgctgctttgcagccggataaccgcctgatggctgtccattccccggccttttcccgccggcagactgtccgccgccggaaaatctgggacggatcagacattttttgtcgtaaccgattaagtcggtgcgtccggctttcttcagcgcttcctccaccagttcgtaattctttggattgcggtactggatgagtgctctctgcatggccttttcatgcggattcgtggggacgtagaccttttccatggtgcgcggatcgtatccggtgtagtacatgcaggtggagatggtggacggcgtcggatagaaatcctgcacctgttccggcatgtatcccaggtcccgcaagtactcggccagctcgatggcctcgggcaggccggagcctggatgggaggacatcagatacgggacgagatactgcttcatgccaagctgtgcgttcatatccttatattctttgacaaactgtcggtacaccttattctgcggcttccccatgcggcttagcaccttgtccgccacgtgctccggggctacctttaactggccgctgacatggtactggcacagttcctttaaaaatttccggctggggtctgccagcacgtagtcaaaccggattccagaacggatgaagacctttttcacctttggcagagagcgaagcttccggagcagttcaatataatccgagtgatctgcctttaaattcctgcacggttccgggaacaggcactggcggttcggacatgcgcctttggtcagctgtttctcacaggcaggcgagcggaaatcagcggtggggccgcccacatcgtggatatagcccttaaagtccggttcttcggtcagaagctttgcctcagccaccagcgaatcatggcttctcacctgaatgatccgtccctgatggaaggtcagtgcgcagaagctgcatgcgccgaaacagccgcggttgctgatgaggctgaatttgatctcccgaatggccggaacaccgccctcctcttcgtaggacgggtgatagttcctcatatacggaaggtcgtaaacctcatccatctcctcggtggttaatggcttggaaggcggattctgaacgacgtagcaattgtcctggtacggttccaccagacgtttccctgtaaatgggtccgtgttgctgtattggatataatagctcctggcatattccagcttatcctctttcatggcgccgtaggatggcagggtcagcgcctcgtagacgatgtccaggctgctggtcttgtataccgttccgtctatgaaggtaatgtctttgatatcgattccgctgtttaatgcgtctgcaatctcgacgacggaccgctctcccattccgtaggagattaaatcagcctgggagtcgatcaggatcgaatgctttaaccggtcagaccagtaatcgtaatgggccagccgccttaagctggcttcgatgccgccgatgatgatgggaacccgtttgtagacgctgcggatcaggttgcagtagacgaccgtcgcgtaatcgggccgctttcccataacgcctcccggcgtgtaggaatcctgctgtctccgctttttggaaacagaatagtggtttaccatggagtccatatttccgccggatacgaagaagcccaaccggggctctcccagcacccggatgctctccggatctttccagtccggttgggcgatgatccccaccttgtagccgtgcgcctccagaagccgggttatgatggcgtgtccgaaggaggggtggtccacataggcgtcaccgctcacatagacaaagtcacattggttccagccgcggatattcatatcagcgcggttcattggcaggtaatcgtgtatcatattgcagctccatttctgtttataatatcgtaataatcgcggataaagtagtcggccagactcttcttctccgcttccatatgcctggaaaattcgtcatccacagcacagaccgtcatgccggcccgtttcccagccagtattccggcgggtacgtcttcgaagacaaggcatttaccaggggctacgcccagacggccagatacattcagatagatgtcgggcgccggttttccggctgccacctcgcaggcggtggcgataacttgaaaatagtctccgatcttcaaagtatcgatgactgcgtctaccatctctcttccgttgctggtggcaatgccggccgcgatgccgcgggacttcaaatggctgagaaattcacgggcaccggcctttaacggcacctgatggcggtatttatcgatggacatctcccgccagatggctttgatgtcttcgatggattccctcagtccgaaccggtccttgaaatagacggcggtctcggaaaaactcattccctcgatctccttctgcagttccggaggacagtcgtgtccatagtttttaaggaactcaatgtcgatatccttccacatccacatggagtccacaagcgttccatccaggtcgaatatgaccgcttttgtctcttctatcatcatcattactcctgatttgtcttttttagcagttccagttcctcatgggtcagcggccggtactctcccggcttcagtgcctcatcgagcacgagcatccccatggataacctctttaagtataccacatgacaccccagtgtttcaaacatccgttttacctgatggaattttccttcatgaatcgtaaggcggatctcagacagctcaccggagtcccctctatgaatgacttccaaatcagcaggaagcgtttccgttccgtctgagagaaccaggccctccgccatacggtctttcgcgtcttctggaagcattccctctattttggcgtagtagaccttgtccacgtgctttttcggcgagagcaggcggtgggttaaatctccgtcattggtcaagaggagcagcccctctgtgtcgatatcgaggcggcccacaggaaataaatcatcccgtttcctgtcggtgatcagatccaccaccgtctcatgcagcctgtcttccgtcgcagagacgacgccctgcggtttatggagcatatagtattcatattccacataggacacgttccgtccatctacggcaaccgtgtcggaggagggagaaatcttacgctcactcttcttctccgttacaccgtttacagcgatgcgtccctttctggccatctctttgatctggcttctcgttccctcgcccatctccgttaaatatttgtccagcctaatggtatccttcatcactgccaccgccatcccggatagtatttgttcttgagcgccatgcccgttcccttggcaaaccccaggggatagccgtccacgcagacgaggcaccagcccttgaccggcccttcctccggcgtcagggagatcgtttctccctttaaataccggatgacgcggtcatcctcctttttccaggagatagtctgcctaaattcttctgcatgaagggtcatggcaagagcctgtccaggctcaaagcgtttgttcttcagttcgcccaggagaagccccgttctcagataacggagttcctttgccggaacaaagttttccggcagatagtagacagaatcatttttaatcatgattctggaatcatcgaattcccggttcatgagggcgagaaaatccgtaagctccgttggaagggctgggccctttttcccctgcggctccgtcctggaacgttcccggctgccagcagccgtcctctccgctccaccgccatttttccgcagcagggatatgaaatgcccctcgcccttaatcttatgaggaaacagacggatacatccgtcgaggccggttccccccgatgcgccttcaaacagagggagcctgatcagttccatctcctggtggttctccagaatatggcagataatctcctcatcctcgcagcgtgaaaaggtgcaggtagagtaaagcagcaggccgcctggagccagcatgcggaccgcctggtccgtgatctccttctggatttcactgtagtactccggtccgcgctcctcatagcttttcaccatatcatcgtccttgcggaacatcccttccccggagcacggcgcgtcgatcagaatcttatcgaaccacgggccgaatacatcggccagcttatcgggagtctcgctggtgacacagatgttggaaatcccccagagctccaggtttttaagcagcgctttcgccctcgaattgctgatgtcgttggagataaggacgccttttccagccagcttaatacccagctccgtgctcttccctccgggcgccccgcacaaatccagaacccggtctcccggctccaccggaagaagcatggccggagtcatggcgctgggctcctgcaggtaatagagtccggcgtaataatagggatccttggccggacgttccgttccctcgtaataaaatccgtttggaatccagggcaccggttttaaatcccaggaaaccagttccggaaatgcttccggcgtgacctttgccgtattgacccgcagtccatacagccgttcctcgtcgaagctttttaaataggcggaaaattcctcttcccccagtaagtctctcattctgtttaaatactcttcggaaagtttcaattcgctcacgtgtgtaactcctgcctttctctatggcaatcttaatatactaataggaatatttcaaccggtatttctgcagatattttaatacccagtagggatttacgctcatttcgtcttcatggtccgtcttcatatagatcccgacatgaagatgaacttcaaaattaccggtggtcccttccaccgtgctgtacccggtgtcacccatgaagcccagcagttctccggcctttacggcatcgccctcctgccactgccggctgtagccgtacaaatgggcgtaatagagataagcgccgccgggagcgcggattccgatccgccatccgcctttctccagccaccccaccttttccacaaccccatccgacatggagacaacgggataatatccccggggccgctctgtccccatgatgtcacagccctcgtggccgcgctctccgccgtacgtgcgcttatccatccagccattttcaaaggtgacggggggagatgcggcgttcgtattttccgggatgggaaagaactttaaatcgccgaggacggtctcatacgcctgtttcagcttcctgtattccgccggtttcacggccagcaggcggtctgtatggcaggcggtatccttgacatcggtcagatcgtaattgtgctcgatcatcagggaagtgagcagatcgtaatcgaggggaccggattctgcgatcaggttacccagcctcatactgcggaaatcatcgctctcacaggtataggcgtccagctggtaataggtaggattgttgtaaaggtaatcgatcatggtcacatgaaagaaggaaagaagcaggattaaaagaagaatcatcatcatatcgatacggcctcatcatatatttgtataaaacaatctattcaggtgctcatgaaaaaatccttcttccgcttctgttccgttgcggtgctctgcgttcttctgttaagtccggcggccgcgactcagggggcaaaaaacggactggttctgtgggccacggtagttctccccacactcctgccgttcatgatctgttccaacgtcatcgtcgcactggacgcgatccatattcttacatttcccttccgcgggttccttcgtaattttttaaagctttcggatgcaggaagctacattctcgtctccggcctcctctgcggctatcccatgggagccagaaactgcagcgattttctcgatggggaacggatcacgaaggcggaagccagatacttattaagcatctgcaaccatcccagtcccatgtttctgctgggctacgcggcttcagagctgccgggtgccgtaccggtgtggatgcttatggccgctgtttatttaccggtggtcctgatcgcctggctgtcccggaagctctatggaatccagacagtctctccgtcgcttccatattccagggaagcacagctgaccttcgatgaaagtctgatggattcctgcgaggtcatggtgaaaatcggcggctatatcatgctgttttcgattcttgtcttttatattacggaactcccgttacataatccggccggaaaagcggcactgcttggttttgtggagatcacaacgggaatccgcgccatctccagttcgattccgtccatggcggggggcatgtggatcgccgccgctaccgccttcggcgggctgtccggaatctttcagacaaagagtgtcataaaaaatgccggattatccatccggcactatgtagcatggaaagcggttcacagtctgctttctgcagcaatctttattctattggcatgctgccgtcagcttccgtgggcggcataaccgcgccggtcagctcctgacggttagaggagacaatatcatagctggactgcatggaagtcataaaggcatcaaatctgccctgtgctccttccatggagtggctgatgatggtctgaaggctctttaacatgtcgtccgtgtactggacggcgctctggcggatatcgttggcgtcggaaacggccttctcgacgatgtcctgggcctgtaaattcgcctgattgatgatctcattggcctgggcgtatgccttctgcatgatctcatgctcgtttaccagttcatccgtatgggcggatgcctgggcgagtatggaatctgcctgctgatgagcctcgtttaagatcacgtcgcggttgctgatgatcttctgatactgtttgatctcatccggaatccgaaggcgcagctccacaagaagctcttccagttcgtcacggtttacgacgatcttactgttggaaagcggctggtacttacaaccatcgatatattcttcaatttcaccaattaactgttcaattctactcatcataatgcgtctctctccttacccgtttttctatctattttctatctgccatcttcctcctgatgcattctgccacactggcaggaacgaatgcactgatgtctccgtcatagaacgcgatttccttgacgatactggagctcaaataggagtattttaaattcgttgtcaaaaatatggtatccacttccggtgcgataacccggttggtctgtgccagctgaagctcgtactcaaaatcagtgacggcacggagtccgcggactacgacatcagcctgattcgcccgcacaaaatcgatcaaaagccctgcaaaagctttcacttccacattgcctaaatctttcgttatttcctttaacatattaacacgttcttggacagaaaacaacggagtttttgaattattattcaaaactccgataattaactgatcggacatccgggccgaacgctcgatgatatcgagatggcccagcgtcaccggatcgaagcttcccggatatacggccgttttcataaaaccactccttttgctataaaaacatgtttattcgtcttatagatcttttctctgcggcattcgtaccccaaggattccagatattcgaagccggtgtttaaatccgcttccacaattaggagcgtgtcctctgaaataagcggggaagatgccagatactctagaacctggcgttcggattccttcccgtagggagggtccatgaagacgaaatcaaagacgtaatccttaccctccagacggcgcaggccggtgataacgtcacagttcatgacaatggactcttcctccagcttcgtggtctgtaagttctccctgatgcattccgcggcctttggattcatctcgataaagactgccctgtcggctccgcggcttaaggcctcgatgccgatgccgccgcttccggaaaagagatcgagaaaggtgctgcccggcagatccggatttaaaatgttgaataaagtctccttgatgcggtctgtggtgggtctcgtatcctgaccctctatggtttttaaaagaagccttctggcttttcctgctattactctcatgaaatggtgtccctcattcttctggtgttatgtaccattatagtatgaaaacggaagatatacaacccaattacagtaaaaaagaaccttcagttttaaactgaaggctcttccttattgtttcttggcttatttaccagccatctgtctttcctgagcttcgatcattttcttaaccatatagccaccaacagaaccgttctgtgcagaggttaagtttccgttgtaaccgttagttaacggaacaccgatctcgtttgcaacttccattttgaatctgtccattgcttctcttgcttctggtacgtttgttgtgttagaagattttcctgacatattgatatgcctccttttcgtctatcaccatgcttttgttttgtgtttttcatggtgtgttttgtgctacactcctattatggctctgaaggagaataatacactagaaggtttttccaaaattttatgtcattgaacacagacttttctaaaaattttcttccatatgaacaaactgtaccttcatacccagcgcccggtaaaaggcggccgcgctttcgttaaaattccagacggtcagttctgtaccttctgcaccagacagaaccgcagcctctttgatttttgtatacagcatacggccaatgccccgccgccgaaacggttccgatacaataaaatcttcaatataaagaaatttctttttgcagagcagtggggaagcggtttccgtcagcttcgcaaaacagagcccggccgtttcacctccgctggtcctggccatatacaagaagtatgtatcatctttttgcatggcctcatactcttcttttgttaaaagtgtcccacacggctgaaaaatatcaggacgggccgtaacgtgcatcgcatgttcctcggtgatcagacggcatatcacagagtaatcgctgaaaactgctctttctatatgaaacggttgagactgctcttgactcatgactgcctccttcttttttcgcagaagatccggccgcgtttaccgtttcccaccagtcaatacggtcttcacgagatattctgccctctcatactcttttttttcaacataaaggtaatactgtcttaagacggattcatccataaaggcagttcccagcgtccggcggccccgccttccgcagtcaggcacggttttccagtcatacgggatctgattcgcagccagaatatcctttacacggttaaaatcgttcagtgaaaatgtaaccagaacttcttttttctgccagaaaaacatggtttgtgtcctcctattgatccgatggttctcccagtattttttcgatcgaggtctttaccagctggaaggccacttcgttcattccgctgttgatgatgatgtccgccagcggtttggtaggttctacatataagtaatgcatgggcttgacggtcgtcagatactgttccaccacgccctcgatatcccgtccgcgctccttgacatcccggatcacccgccgcagaatccgttcatccgcgtccgcctccacaaatatcttgatgtcaaacatatcgcggagccgctggtcggcaaataccagaattccctccaccagaattaccctttttggaaggactgtgagaaattgatccgaccggttgtgctgggaataatcgtatacgggacattcaatggacttaccgccccgcagtctggacagctgatccaggagaagctccgtctcaaacgcctccggatgatcgtaattcatttttttccgctcctcaaagggaatgccatcctgctttttatagtaattatcgtgataaaggacggcgatatcatcgtgaaacgcatcctttaaccggttggtaaatgtggatttccctgatccggttccccctgcgattccaattaatatgctcttcatagatttattcctcccgcgtttttttgtatttactctctgtattcttttgattcgatctgcgaatctcattcaaacgctccaaatcctctttggtgcatccatttccgtaacgcgccttctcgtatacctgatggtagatcccgcagagggaaggctcctccggaaatccgcttttatgttccagctcctccggtgtttccgtccgggaaatccggcctctgccgtcaagccgtcttaaaatttctcttttatacgccctgcggattcttccctcaatggtaaaatctctccacagaggcgttcccttcgcctgtccggtatggatcctgctgaaaacaacggccggtttcatgaattccttttcatctccgtcttctctcggctttaacagacggatcagcaggaagaacagctgtctgagcaaatatacagcgagaagtactatgaaaacgacggcaacggctgtgagagccgcatccaggatttttgcgatgagcgaaggcgccgccgcctcttctcccagctccggagggataaagctcccggaaggcatggattctactggctcgtttacggcttccggaagaaaacgggcaagaaagcgaagaatggcggtcaggacagactttaatccgttcaccagccactccaggtgaagaagggaaaacacagccatgaaagctcctgttacagccagaaacacggccatgtagactccatttaccagcttcatctgcgatttcggaatctgatccgtcgccggatgcatgctcagaaaactgtcgcaggaatggagctgcagatgaagcagatagaaaaggattaccagaaataatcccgcataccctgctgtcatgagccgcgaactgggaatgaagtatccggcaatgtagaggaaaacagacacgacagccaatattatatggattccgcttaaatcggcggtaatccagcggttgatccatttaaatcttgtcataaggcacctcccacttcatcgtcagtgcagccgggcagagggaaaacactgcctcatcttccggccgcagcggtgcgatccataaggatcccggactatagcggcagaattcctggtatgctgtctgaagctccggccgtttgcaggatgagatcatgatgtatagacagtcttccgccttcttttccagacttccttccctcatcagtgtctcgaagggagtcagggaaatgtcgtagcggagacggctgagcgcctccatgcaccgggtgacgtggctcgctcccgccccggcggggacgaaggagggctcttcggccgccgcgtcgatgccgttgctgaaaaatccggttggaattcccgcggagacaaaggcgtcgatgaaggaaccgcagatcgagatggcctcctcccggagcgcctccgacgcccacggatagtccgaatccatattcagaaagaggaagatattctgggaggccgtggactcatggacgttgacctttaaagcgccggttcgggccgtggccttccagttgacactgcgcatggagtcgtaggtctgatactcccggattcccttcagttcaaagggatcggtaaccagtctgcttctcgacaggcaggtgcccatcatcttctgaaatggaacattcagacggccgcagtccgcagccgccggatagacgtataaatgagaatccagggacaaagtctcgatgaaatggccggaaaagaacagatcatggctgaccagatccagactctttatttcgtaatatccgcgtttgcggcagtagaaccgcagctttctcgtgatcttctgataaggaaagacggagaagacgtcgttgcggtacgtatagtcggagacagcggagttctcccccgtgacgaattccagttctctgccgatgcggaatttgacccgcagaatcgagagcggaagaaacttcgcattgacaacggtctccaggagatacgcctctccgccgcagaccgcgggatttccctgaaacgcagcgtccgcagtcagtccctttttccagaaccgctcgtataagacgcgctgaaggacatagagaaagcaggccccaagggccatcaggatcagttccatttatgtattccactcctctgtaggcacaaagacggtatttaagagctgttcgataatctggcggcccgtacttcttccggtcagcgttctggcgagaaccagcctgtgagccagaacgggaacggcaaggcccttgatatcctcgggaaccacgtagtcccgccccttcaccagggcataagcccgggctgcccgataaaaggccaggctgccgcggggactgacgcccccttccacttcgctgtgcttcctggtggcgagaaccagttcgacgagataatccatcagatggggatggacgtataccgcctccgcctccttcatcaggtttaaaagcgcctcccggccacatacggcggtcaggctgtcatagggattctctttgccgaagcgttcaaggatctgccgctcctcccccgcgtccggaagtcccatggggatctgcatcagaaaacggtccagctgggcctcggggagcggatacgtccccgccgtctcgataggattctgagtcgcaataacaaaaaacggttcttccagcttcttcgtctccccatcgatggtcacctggtgctcttccatacactccagcaggctggactgcgtcctgggcgtggcccggttgatctcatccgccagaagcagattggtaaacaccggaccgccgcgaaagacgaactctccggccttctgattgtaatagttgaggccggttatgtcagacggcagcaggtccggcgtaaactgcaccctcgaaaaagacagctccatgctctttgccagtgactttgccagcatggtcttgccggttccgggaacatcctccaaaagtacgtggcctcctgccagaatcgcagagagaagtaagtccgtcacctcttcttttcccaccagtacccgtcctatatttgccttgattgcttcgatcacttctttcattccagcgcctcctgccataatatggaaattataacctttcctgctattttatcaaattaaccgcaggcatacaagaagaaccgcctctttccggataaagaggcggtcgtttttcctggttattcagttaatttacggtatctgcattctcatagaccacggaaaccggcttcagttggttgtagtaattggcaaatgtaaccgtcatatacggatatacatagatatacgctagaccgcaggtaacgccgccgagcagcatccagaagaagaaagagagctccaggataaagtattccatcttgtggccggccatcatctccttgctctcgcggatacactgcataattcccttattgggatcctcaaccatgatgaagatggcctgggaataacggtacgctgcaatgatacccggtattacaagcagtatacaccaaagcaggacaaaaaccgatatcataagcgtcagccctatggctttcagcagataacgaaccgatgaaaacaaatctccataagacatggacccatcccggtttgccactttcaggcagtagctgctgtatccaaactgtaaaatcgtgctgatcactaagtaaatgacaaaaaatacgagagaagatacgatatacgtgctggcttcccctgtgtttacggaagatcccgtgccgatgatattgccccagaaatcgagaataaattgaacacccgacagaaccatgaggatcactcccatgatgagcgtaaccacataggggtttacagccgcctcccgcatcttattttttgcgtcaaattttaattcctgcctgttcattcatgccctccttatatatcgttgaactgttatatttttaacagcataagtctatcacgccgacttactaatttcaaccattttctgaaaatgtacttaatttgaaagtaatacgtttacagatttagcttgtcataacttttttccaaatacagattaagttttttgccaagctcggcgtgatcctctgagctgagctccggatcctcatccaacagccggttgacctcctcagacaccgtctttaagatattggcatcggtaaagatgtcggccagcttgaattccagatcaccgctctgtctgagcccgaagatgtctcccgggccgcgcagctttaaatcctcggaggcaatgaagaagccatcgttggatttgctcaggatcgtcagacgttccctggttccatcctggccggagccgtccaccaggatgcagtaggactggtgctttccgcggccgacacggccccgcagctgatgaagctgggccagtccgaagcgctccgcattttcaatcatcatgacggtggcattgggaacgttgacgcctacttccacgacggtggtggagacgagaaccttgatctccccggcggcaaaccgttccatgaccgcatttttctctttcgccttcatcttaccgtggagatattccaccggaatccccggcagcgcgctctggagtttcttcgcataatccagaacattctccgcctcgatcatctcactggcctccaccatggggcagatcacatacgcctgacgcccggcggccacctcccctttgataaaggaatatgccgtgttccggtagctggtgtccacgacacagttcttgatggggagccggttggccggcagttcatcgatgatggaaatatcgaggtcgccgtaaatgatgatggccagagttctggggatcggcgtcgcactcatgacaagaacgtgaggctcgtccccttttccgcccagcatctcgcgctggctgacaccgaaccggtgctgctcgtcggtgatgacgagggccagcttgtcgtagaccaccttctcctgtatgagcgcatgggttccgacaatgatatcggcttcgtgggaggcgattttcccgtaggcggtccgcttctcctttgccgtcatggaaccggttaccagcaccacctgtttgtcaatgccattttcctcgaacagggagagcatggactcgtagtgctgtctggcaagaacctctgtcggcaccatgagcgcgccctgatatccgttgtaagccgcctccagcagggcgaggacggcgataatggtctttccggagccgacatcaccctgaattaaccggttcatcacctttccgcctgtcatatctcgaaacacctccgtaagcaccttgttctgcgcgcccgtaagcgcgtagggaagatttttcacgaggctgatcacttcatcggagggcgtcatccgaaagtggctttcccggtccacacgcctgtcctttagacggcgaacagccataagaaacaggaagaattcgtcgaaaacgagccgtttcctggcgaagagcagttccgtccggtctgtggggaaatgaatatgttcgatggcaaaattatattccgccagttcatggcggatccgcagatctaagggcatgtaatcgcggaccatctgtctcaccgacagggcctgcttcactgcccgcacaatggtcttgttgggaagcccctttgtctgtccgtagatgggctgcatggagtggataacctccccgtaggcatcgcccagaaagatctccggctgctccatcgtaaggcgtccgtttttcttaaccacccgtccgcggaacacggcgcgcataccggcctttaaagtggcgtgcagataaggcatgttgtaccaggtaagggtcagggaacccgtaatgtccctgatcatggtggtaatcacctgaatatggctgtaacgcttcacttccgcgcttttaaacagcactccggagactgccatcacggtatccggcttcagttctccgacagagaccggttcctcgtaggcatcataggcccgcggatagtattccagcagttcatccacggttccgatacccagcttcccaaacagttttccggtcttctcaccaatgccttttaaggtatccaaaggttgttgattcatgtttctttcacctttcccaaaaaagttcccgggcagattgtctgcccgggagctgttcctgtttcttctgttctactctacggatatcagataatagtagattggctgaccgcccggatggagctctacttcacagtcgccgaacgactcctctgccttctcacgaagcgtctccgcgtcttcctccgacacgtccgcgccgtaatagatggtaatcagctcagattcgtcatccaccatggatttcaaagattccagcgccgtgtgctcgatggctttccccaccgccaggattccgtggtctccgagagccatgatgtcaccctcggtgatctcgatgttgtcaatcatggtgttgcgcaccgcataagtaatctgtccggtcttgactcgctgcatctcctcggtcattactttctcattctcttccgctgataaatctggtgcgaaattgatcagagcggtaattccctgcgggatcgttctggacggaattacgatgacatgcttattctttgtaagcttcttggcctgttctgccgcaagtatgatgttcttgttgttcggaagaatataaaccgtatcggcattgacacggtcgatggcgtttaacatatcttcggtgcttgggttcatggtctggccgccctgaatcaggtaatcggctccaattcccttaaagatctcgtcgagcccctcgccgacggatacggagatgaagccgtaaggctttctcggtcctgcgtttttctcttcgtccgctttctgctgagcggccagcttttccgaatccttaatcagtttttcctgatgctcttccctcatgttgtcgatcttcatacgtgacagggagccgaaggtcagtgccttctgaatcgcgagtcccggatcgttggtatggacgtgaaccttgacgatatcgtcatctgaaacgacaacgatggaatcgccgatggattctaaatatcccttaaattcatgttcgttcttctcatcgtaaggcttctccagattcacgataaattccgtacagtaaccgaacttgatatcgaaatcatcggttaccgcagcaccgcctgatacgcttccggcgctcgctgcaccttccacggataaatccagttccttgcccatcaggcagtcgagagcgctctttacgacctgcataaggccctgtccgccggaatcgacgacaccggcctgtttcagcacgggaagcatctccggagtctggctcagcacgtaatcgccgtgttcgatgaccttctgacaaaattcgatgatatcttccgtctctgtcaccagttccacagccttgtccgccattcccttggcaaccgtcaggatcgttccctctttcggcttcataacggccttgtaagccgtctctgtcgctctgacgaaggaattcgcaagagtcgtcgtcgtgatcttatccaccgtctttatttcttttgtaaagcctctgaaaagctgggaaagaataacgccggagttgccgcgggcgcctcttaacgagccggaagaaatggcctttgccagagattccatgtccggatgctcgatggccgccacttcccttgccgctgacatgatggtcatcgtcatattcgtacccgtatccccgtccggaaccgggaacacgttgagttcattgatccattccttcttagcttccaatccttttgcaccggccagaaatgctttcttcagcatctctccgtctatatacttcatacccacaggtagtttcctccttaatctatcactcttacaccttcaacgaagatgttgatcttatctaccgtcatgccggtgaactcttctactttgtacttcacattttcgatcagattgtcagctaccgccgaaatgctgattccatatgctacgatgacatggaagtcgatggtgatatggttgtcctgtatattcacgttaattccgtgcgtcagactttcgcgttttaaaagcttaacaaggccgtccttcatgctgacagccgccatgccgacaataccgaaacattctactgcagtagtgcccgcgtacatagcgataacatcagggccaatctggatttcacccagtttattattgatgtaacccttcataatttttacctcctatcattctgactgatttgattatacattattttcccaaaaaaagaaacaaatttttaaatttcacttgcaaaagtatgcaatttctgttatcatacatttgttgtggatttttataacagaaaatccaagtagcgtttaaggaggtgcaatcatggctaaatgtgcaatctgtgaaaaagctgctcactttggtaatgcggtgagccattcccatagaagatctaacaagatgtggaaagcaaacgtaaagtccgttaaagttaaagttaaagttaacggaggcaacaagaagatgtacgtatgtacttcctgcttaagatctggtttagttgagagagcttaatcatttaggaaaactccaggctgataatagcctggagctttttttgtattgccggaaaatgctcctgctgaagcagttttagaactctttattttaactggaaacgggtatcagcgcatctctcccgtttccaacaaacactctctaccaacagaataagttgtatcccagtaccatacaggcgatgatgaacaatatcgtcatgattgttgccgggataaaaagcagaattgccattcctgcgccaaagcagaacagcatcagaccacatactctcttcatataatccctcaatccatttacatgctatatgatatagtatgcggcttatcctcttcttattcagttttttcctcgtctgccgcagccatctcttccgctacctttaatgcctcaggggaaacatcttgggacccccctgtaaacttattgacaaaatcaggcaccatgtccaggatcttcgtcatggcatcctgctgtttgatgttgaccagcttcgtcacgccgttctgaatgattaaaatggcgctggggctcatcttggcattcataccgcctgcgcccttctgctttgcgctttcagcaaatgaaccggcagccatgccgcaggtcacatcaaccagaggaagaatgatggtatcgtccacctttactgcctctcccactacggtttttgtcgttacaaaggtatccatacccttgaacagagcctccactgtagatgtaaaataattatctgccatctgatctgttcctcctttaacgaagccattttcttaacaggcctctgaaattcttatcgagcagcatcctccccgcaatgagaagcagtgtgccggcccggattcttcctttaaaatgtccctctgctgtaaatacctgtctgtcaaataccgggtaaatgtcaagctgcttatggcagaacgggtaaaccgcactgaccgcagttaaaacctgaccggtcgtatagggatcgtcgaagccgaataccacttcgccctttccttttttgggaaggaggtggcggatcagcttctttaactgcctcagaagaagacggattgtctttcggttattttcattggaaatccaggcttgaatctcttcttttttctcttttatggtttttagtttatcacagatcccctcgaaagaatacttaagttttgcgaaaattgacgaaagcctgtcggcggccgcctgggcctttccgccgattgtctttttactttcatgttccttgtcggaactattctgatctgaaccttcctgcactgaaccattctgatttgaattaccctgacctggctcttcattcagccgtgacgttttctgctgctccattttctgcggctctttgcgcttttcttctgaatttgtgcgctcgctgccagaagcattgtcttcgggaagttttccttcttccgtgagccgttttttcccggagcgttccacatccttcaggatatcgccggagaattcttccgcatcctcgtcagtcacttccatggcgtggaccagcatctcttccgcatcctctctgctctcttccacgggtttgaagagccggaagccgaacagccggatgagaatggagaactcgtcctcataagctgccgttacagagacaatatgtagcagccatgtgacacggactttccctttcagccgttcgtaataagagccttcgatccggtatctgaccggtacgaagagaatcagaaggagcacgccgagaacgagtcccagcagaatcagaaccagaattcccagcagttttaaaataaataatatgataggaagcatggacacctcacatctcgccggcttctggaacatgttcagacatgtttcgggcctgattgtcgcggccgctcgtacacggagcgttcgagtgatcgtttaaatatccggccaaatcgaagccgccggtattccggtacagttcatctataatctgccttgtcacctccagggcctcccagtagtcggcagcaattccgatgatgaagaactcctcatccctgtaccacggggccgaaagctccatggccggatagatatcaagtacattattcccacttaatgagggtgtaatcacataggcccctgaaatcaggcgggaatttctgattgcctgaatgatttgataccgtttctttttcgctttgtcacccacatataagtggtcataccagcttatcttcatattccatcagctcttccaataattccttgcaggtttctttttccgcctcgtccccgcagctttccaggctccctctgatgtaggatttgatctcatcaattgaattaaagtacaccggaaggtccgagagcactttcgccataatggcgcgcatgactggtctggaggtgccggaaaatacggtttccagctgaccaaaatacgcttctgcggttttttccaggtacgccctgtctaccagctcctgcgtgccgtcctcttcttcgccgctttctgcggtgaccttctttaaatccataaaggaacttccggaaaggagaagatcaacgttgccggctctcacataatcgggatcggcgagcagctccggtgtctccggcggaaattccgaacggagatatctctcataataggcttcctgacgcccttccagctgcgtaagaagcgccgtgaaggactcttccgcttctccaccgccatttttcgttaagccatttaacactccggtgatgatggaatgatagagcttctcctcgctgacatcgattactgcgtcgctcttagcgagagaaagaacgtataagtcgttgataatttcctgcaggcttacgaagcattctgcttcttcattcagctctgcactcacacccataagcttcgcctgggcttccgaaaacgcctccggtgaaaggctgcggtaatccatatggccgaactgcttaagcgtctcatataaggatctgcgtccctccgccatcccttccggaagggatgccatggattcagtcttaagcgtatacatcatgtcatttaagctgtccacaggagaaccggtataaaccgagagcccctccagcatgaggctgtagaatttctgctttgtcagacgaacagggagctggccgatgatctggcggatgcgcccgttcataacggcagattccttggtattcgtgataaatgccatcagcatatccgtaaaggtctcgtcgttgtagccggtttccggcagagtcttataggatctctccagccggtttaacacgtattcgtaaatctgaaagcagtctgtgtaagccgtcagaatctccacctcacgggtaacctcttcccgaagctggtccagccggttgaggatctcgttcccctccagatacgctccaatgagctcattgagggtcagaagaaacgcgccgccttttccgggaagctccggttcctctgtcagggtttcgtataaagtatagtaattgagtgccagcctcgtataagaatattgatacgccgctgtcatctgtttttttatgaaacgggtttccaatgtattatcctcctgaagacttatccccgataatttgcgagtatagacctgcgcaatagatcgagagactttacgacggcctgctctctgatcttatcccggttgcccttgaagtggtactcttccactttcaccttatctttcatatagcaggcaatataaacgagccccacaggcttgtctccctcggtcgaaggtccggcgattccggtgacggcgatacagacatcggcgtcagttgcaaatacaccgcctgtggccatctccttcgcagtctgttcgctgacggcaccgtatttcttgagggttcccttgctgacatcgagaattttcctctttgccttattggagtaggtgacgaagccctcacggaatacttcggaggctcccgacacattaaccaggcgcccggcgatcaggccgccggtgcaggactccgcggtagtaaccgtgagctcatactttttaagaagacgaacgaccgccatctccagggtctcctcttcctttgtggtatagatatcatcaccgaaacggttcttgatctcctttacgacaggcttaatcaggctcttggccgtctcgtcatcggccgcgcgtgccgttacacgcagatgtacctccgccgtctttgcgtaaggggcgatggtcggattcgtctgtgcggcgatcaaatccttgatctggtctgccacctggctctccccgtggccgcagatcttgatcatctgggaacggattacctcaggctgtaattcctgaagataaggggataccgcgtccaggaaaagcggctttaactcattaaaggggccgggaaggagaatcgctacctttcctgccttttccagaatgagtccgggggctgtgccgttatgattgtcaagaactttgcagccttccggaataagcgcctgtttccagttgttttccgtgataaccggatagatgctattcttaaaatacgtctcgatccgctctctcgtatgcgggtcttccaccagcttaaagcccataacctcggcgcagacttcctttgtgatatcgtcctccgtaggtccaaggccgccggtcaggatgatgatatccgccctttgcagagccgtgttaatatcttctgccagccgttcccggttgtctcccactgttacctgatggtacatggagaggccgagtgacgcgcatttctccgcgagaaactgggcgttggtattcacgatatttccgagtaaaagttctgttccgactgaaattaattcaacaaccataatgatttacagactcccttccgtaagaacacgataatttttcgcaatgtaatcgatcagtgaaaccactgtcagaaccagcgcgatgacgctgaaaatggtggtcagaatggacagtgccgggatatttacaatcagcagcacagacataatcatctgagagacggtcttaaatttcccccagtagctggcggcaatcacgacaccgttgtcagacgctaccagacggaagccgctgatgatgaactcgcggctgatgatgataatcacgaaccaggccggaagctggccaaggccgacgaaacagattaagccggaacagaccagaagcttgtctgccagcgggtccatgaattttccaaagttggttaccagattgtatttcctggcgatctttccatccagtaagtctgtaaagctggctacgatgaaaatgaccgcggcgatatagcggtacgtctggctcacaccgccgtcaagcagcataaagagtacaaaaaacggaatcataatgattcgaagaatcgtcagtttattcggtaaattcatcttctatctcccctattaaatcgtattccagcgcgcctgtcaccctggcccttacaaaggctccggacatcagctcctcgccggtctggatgaaaatcatgccgtccacgccagggccgtccatataggttcgtcccacataggcgttttcatcggcaaccttgccttcgatcatgacatccagggatcttccaaccatggactgagaatggtcaaaggagatttcctgctgaagctccatgatggcatcgcgccgttcttccttcacttcctgcggaatctgatccgggaatccggccgccggagtgtcttcctccgcggagtaagcgaacacgccgaggcgctcaaactccatctcgtccacgaattccatcagcgtctcatgatcctcctccgtctctcccgggaatccggatatgagggtcgtacggattgcgatatcgggaatctcactgcggagtttaccgacgatctcctttaactgctccctggaagttctccttcccatgcggcgcaggatggtatcgctggcatgctgaatcggcatgtcaagataatggcagaccttttcctctgtttttatggtttcgatcagctcatcggtgatctcctccggatagcagtactgaatccggatccactgaaggccggaaatgcggcatagtctctttaaaagctccggaagcgacttctttccatagaggtccacgccgtacagcgtcgtctcctgggctaccaggatcagttcctttacgccctgatcggccagtgactgtgcctccgataccagccgttccatgggaacactgcggaaattgccgcgcaggctgggaataatacagtaggtacagtgcttgtcacagccttcggcaatctttaagaatgcgtaatggcctccggtagtgattacccggtctgtcttcacctcaggaatgagatccagatcgtggaagcactggacgtgctccctgccgccaagcgcctcggccagcacatgggatatctcgtcataggtggtggtaccgaggattccatcgacttccggaatctcatcgatgatctcctgtttgtagcgctgagccaggcagccggtaacgatcagcgccttacacttccccacttccttcatctgcgccatctcgaggattgtgttaacgctttcctccttggcgtcaccgatgaagcagcatgtgttgatgacaatgacatccgcatcgtactcgtcatccgtaaaggtatagccgtccttgtttaaaagccccagcatcatctccgtatccaccaggttcttatcacagcccagcgaaatgcatagtaatttcataaaatattataactcctgtcttttcgtatgtctttttgcatctttatttcgtatcatgtatttgcatcattgcatcattgcatcattgcatcattcatttcgtatctttgtttcaatcctcgcggccagtgaactggcggacatgctgctgtccgtaacaccacggtgaatggaaaatggaaaggccatctctgccaatgtggagacggccttcaaccccgggcactgttaagaagtaacgcagccatctgatttgtctaaagctccatacgccgcgttgtcgtcaatcgccgtactccgtacgcctcattcctccgccttgcgcatgaagctttatcctgcatcatctgtccaagttgtttcttaacagtgccttatcaatcgtcttcttccgttgcgtccgcttcgcttaagatctttacatcgccgtcatataattcttctacggcaacggaaagcggcttctttccagcggttggaagatcagactcagctcctccgatgatctgtctcgctctctttgcagcggcgatcacgatggaataacggctctgaacaaccggctgttctcctggctctacctcgctgtttactactttaattaaatctgaataagatggatgtaacatctttcattcccctttcctgatagctatatattctttaattcttccctgatctgggataaaaatgccaaattatttgaaactctgctgtgctgtaccgcaatcatcttgtgaagctgctctgtacaggagctgatttcatcgttgattaagatataatcgtaggaatccatgccctccgcctcttccactgcccggcgaagtcttgcattgatcacatccatgctttccgtgcctctgccgatcaggcgtctctttaattcttccgcgttgggcggcatgacaaagatcaggatggcttccggaaaacgttcctttacttttaaagcgccctgaatctcaatctctaaaagcacgtcttttccctgttccatctggcttaatacatactccttcggagttccgtagtaatgattgacatactgcgcgtattcgatcagcgcatcctgttccatcatctctttaaagcggtcttccgtcacaaaaaaatattcccgtccatccacttctccctctctgggattcctggtggtagcggatatggataacgcataattgtcatacttctcaagcagagccttcataagggtgccttttccggcgcctgaaaatcccgatatgacggccagcacaccatgttcgttcataagtttccacctcgttatgagcacttagcgcctctacttagcgtctgtactctattctatgttctgaatctgttcccttaccttctcgatctcggtcttcagcgcaatggccttatccgaaatctccaaatcattggccttcgataaaatggtgttggcctcccggttcatctcctgggcaatgaaatccagtttccttcccacgctgccgccggcttccagctccgccttcgtattctcaatgtggcttctcagacgtacggtctcttcatccacacagatcttatcggcaaagatcgtcacctctgtggcgattcttccttcatcaatggtcgtattggaaagcagttcttttaccttgtcttccagcttggtgcggtactcctccataatccgcggggagcgctcctcgataaaatccacaagactggtcataaagcttaacttgccctgtaaatcagcctttagattctcaccctccgtgactctggtatcaacaaaccgtctggcggcctcttcaaccgtctcggacagaagcttccacatgtgttcctcatcttccggaacctcctccatcgagagaacttccggacatctggaaagcgtggatactgtcacatcatttcgtataccaaactgagtctccatcctggcaaaataatccatatattcggcggcaagcgcgctgttatacttcaagcacagcttgttctccgtgtagtcttcataagtaataaatacgtcgacttttccgcgctggatataattcttcagcagattcctgattccggcttcaaaaaaattgaacttctttggcatcttgatgcttaaatccaggtatctgtgattgaccgccttcatctcgacggaaatcttatattcatccgtgacggtttcgaatcttccaaaacctgtcatgctttttatcattccttgtgccttcctttcgccatagataccatccattataagtcataataaaaaacaagtcaaatagttttctggacggttctttctcgtatataaacctctttgcaataataggctgctattgcgtctttagcaaaatagcagacctgtgaaggtctgctatacaaatattgcttttaatattaactacttttaaacgctcatctattcccgtggttattatacatttattgtcttataggctatatcgcaccgttttttatcatgcgctattcccacacacagaacttcaccagtcagtcccgtataatattggttgtcaaggatttgttttaacgcctcctcttttaactggtcaatattctctccctgtttaaattccaaaatcacattgatattctttggtgataccgactgtagtgtaatatcgctccgaccataaccggcttccagattacttgtcaccttataggattcgcgcagagtaatgcacatccccagaaacagcatatggtaagcgttttccctcgcgtccatgtagctggtacaggaaagcacaatatcctgatacagtgaaagaaacagatccatgtccttatttaaaaggcaggacatcatctgctgcaaatccagtccatctatgccggatagctcggcaatcagcatctgaaattctgacatcacctcgtcatttggaatacgcaccaccactgtgttttggtctatccgccgtattgctgtcaaataaccggaatttactaaaagcccccacaagctgtaattactgtccctttctacatatgaagtttccagtgtaatccacacagcaatttctttccctgcaatcaactgttcaagtttttcccagaaccttcggtccgctttttttaaagccattttcacgagatagtttgaggaagtatttatccagtaattatccaggcttcccagatcggcataatttaggattgaccagggattatacatctcaatatccccaaaccgatatccgtcatattttctgcgcacactctcgtccatcttcaagccgtagtcagctaaaagctgctctgtctcttcagcggtaagtccaaaatacggagcatatgttttatgcagcaccgtataaaccctggcattattaaactgtgaaaagacgctctcttttgcaacccgctgaactcctgtaagaagagcctgccccaatgcagggttccctttcatggcgcttccatacagattggagaaaaactggcctaactgatcgtgataaccatattcatgactgctcatgattggctggtcatattcatcaatcaataaaattggcgaaataccgtagctgtctttcacaaattgtgtcagcatctgtattgaaaaggaatactgcccatggttggcctgcggatccctcaaaacatcaatcatttcataaaaatcccttgtttcaaaggaatccttatctaatttgtttcgaaggattttttcgtatttcaagtattcctggtacagattccgcttaacaaggtacagcagttcatcaaccgtggcacctttgcagtctttaaatgtaaagtaaatgaccgggcgggaattaatctgctctgcatattccgtatccataattgccagtcctttaaaaatgtccctgctgtcttttgtaatatcaaagaattcccggagcatcgtcatgtttaacgttttgccaaaacgtcttggacgggcaactagcgcaacctcgtccttcatctcaataaaatcttttatcatccgtgttttatctacataatatgcatcattctctcgcagttttcggaaatcatcatttccaatgggtaaaatttttcttcctgccatatgctgatccttctttcccattcactcatctgtcctcatcataccatatatccaagcggctttccatagatatcttttcataacgtaactggacgaaaggtggattccatagtataatatagccagtttcattcagtcagttaaaaaggagaacagctatgaagaaggaaagtatgatctggtacgatagaaagcgtctctggtgcggactcccatggacctttacgaagtatggaatggacgagggccggctttttgtagagaccggctttttaaatacgaaggaagaggaagttcgcctctaccgcattttaaatatcagtttgagcaaaaatattatccagaggattttcggactgggtacgattcacattgacagcacggatctggatttaaaatgcttaagaattaccaatattaaagacagcgaccacgtgaaggagatgctctccaagaaggtggaggaagaacgcttaaggaaccgtgtcagcgccagggaattcatgaatcacggcgaggacggcgatgatacagaggcggacttagactcgtttgaagggcatgaacattaggcggacatagatattagacagacacggatattagaagacaggaacacggaaggatcgaggtacaacaatggcattagacggaactgtaatggccagtctcacagcggaaatcggaaatcggctggagggcggaaagattgcgaagatcgcccagccggaaaaggatgaactgctgtttacagtcaaaaatcaaaaaaacacatggcgcctgctcatttcggcaagcgccagtcttccgcttctctactttacggagcagaacaagcagagccctatgacagcgcccaatttctgtatgctcttaagaaagcatattggaaacggccgtatcatgagggtcagccagccggggctggagcgtatcatctgcatggagattgagcatctcgacgaattgggggacaagcggatcaagaaactctatattgagatcatgggcaagcacagcaacattatcttctgcaatgacgaagacatgattctcgacagcatcaagcatatttcggcccaggtcagctccgttcgtgaggttctgcccggacggccctattttatcccgcagaccgtggagaaaaaagacccgctcaccatatcggaggcggaatttacggaactgatcggccacacggccgcgccggtacagaaagcgctctatatgaagctgacaggcatcagcccgatcgtcggcacggagctttgccatctggcctccatcgacggcgatgtgtcagccaatgaactgacggaggcggagctcatccatctctaccatatgttttccctgatgatggacgacgtgaaaagccgcagcttcaccccgaacattatttattaccagaacgagccggtggaattttccgctctcccgcttacctgttttgaaggagaaaagtaccaggccgtaacttacgattccatcagcacgctgctggaggaatactatgcgtccaggaacatcttaacgagaatccgccagaagtccgtggacctgcggaaaatcgtccagaccgctctggagcgaaactataaaaagtatgatcttcagatgaagcagttaaaggatacggaaaaacgcgacaaatacaaggtctacggtgaactgctcaacacgtacggctatgagctggagggcggcgagaaaaagctcacctgcctgaactactatacgaacgaggaaatcactatcccgctggatgaccagctgtcggcccgggaaaattctcagaagttttttgataaatacaacaaactgaagcggacgtacgaggccctgtcggaacagaccctggaaacgaaacgggaaatcgatcatctggaatcggtcagtgccgcgcttgatatcgcgctgaaggaagaagatctcgttcagatcaaggaagaactgatggagtacggttacatcaagcacaggcgcgctggagacaaaaaaccgaaaatcaccagccgtcccttccattatatcacctcagacggatttcacgtctacgttggcaagaacaactaccagaacgacgaactcaccttcaagctggcgaatggcggcgactggtggttccacgcaaagggcattcccggctcccacgtcattgtaaagacggagggaaaagagctgcccgaccacgtatttgaggaggccggcgccctggccgcttactactccaagggccgggagaacgagaaggtggagattgactacattcagagaaagcatatcaggaaagtggccggtgctgcaccgggatttgtcatttaccacacaaattactccctggtggccgagccgaagcttcttctcgaggaagtcagcgaaaaaaagaattcctgatccgggagatgattttatacagataagaatttgcccatttcatacaggcggcatagaatcaggccgtcctggaggaaatgggcttttttgtgttatatgaccgctgaaacggccgcgctccggcgcgcgggtccggcttagcggactctttgtgaaagaataaacttgacatgaaatgtcgtatttcgtatgataaagccactggaggtgaaacgtttgaagagtgaccgcatgtttggaattctgtgtattcttctggaacgggagaatgtgaccgtaagagaactggccggatattttgaggtttccacacgcacgattcacagggatttgctggatttatccgcttccggatttccggtggtgacgagacagggagtcggcggcggtgtctccctcctgccgaatttccgctataataaatcggcgctcagcgaagatgatatgaaagtgatactggccggcatcgaggggctggccaccatcgatgacagcgcgcggatgaagacgctgctggcgaagctccgcttcagcgacggcaatcggctgctgctggaaaatgacatcattctggatttcacttcctggaatcagaacagctctttcctatccaggatcgggatgctgcggaaagcgatcgccgggcattttatcgtggaaatgggttactgcagccccagcggcacggtgacgagacgcgtcgagccgtataagctgattttcaaacaggaaacgtggtacctgctggccttctgtctgctgagacaggaattccgcatgttccgcctgagccggattacggatttagaggtcagtgattccgtctttgatgaacggagcgattatgagattccttcgatggaaagccattttgtcaacgatggaggccaggcggtcaccgtgaaaatggaccgttctcttgaatttctggcgattgatttctttggccgcgaaaatctggtttaccgggagaacgatattgttgttacatttctcaccgggaggccggaatgggttctgagcactttttccggattcggaaacaaagccgagattctggcgccggacagtctccggcaggaaatgaaacagtatctggagcagatggcagcattatattagacggataacgtgaaatatgacaggacgctgtcatatttaaacagttatactcgtatcagaaagatctgaatgttctcagacatttacagaatatgttctcagacatttacagaatgaaatcgattggaggtaccgtatggcagttgataaaaaatacgaggcggacgtggccgcgatcctctcccaccgctacgaccagggaggcacgctgtgggacacaccggatcaccgcctgcagaaaggggcgccgttttccactctggactgtgtgagctatctcctggagctggggatggacccggaagaacccatattaaaggaggccgcagatctgatactcagcgcatggcaggaggatggccgtatcaggctttacccgaagggaagtatttatccctgccatacggcctgcgcggcgcaggtgctctgccatctgggatatgcgaatgacgggcggctgcagaccacattccgttattttctggatacccagtatcccgacggcggctggcgatgcaggaaattttcctttggacacggtcctgagacggaatactccaacccgcatccgacacttctggcgctcgatgccttccgcttcagcgattatttaaaccgggaacctgcattggaccgggcggtggagtttttactggagcactggacgatcaagaagcccatcggcccgtgccattatggaatcggaacgctgttcatgcaggtggagtatccgtttcggaactataatctttttgaatacgtctatatcctctccttctatgaccgcgccagaaaggatccccgtttcctggaagcatttcacgagctggaggcgagaacggtaaacgggcagatcgtggtggaacgggtcgtgccgaagctggctaagctcaccttctgtaaaaagggggagccaagcgaactggggacaaagcgctttatggaaatacaagatcattggaggaagatgccatgtacgaattgattccggttacagaacagagctactatattcaaaatccctcaaaaatcggactggtcaggttaaatgataccgacgtgtgtctgatagacagcggaaacgataaggacgccgggcgtaaagtgcgtcagattctggaagcccattgctggcatctgactgccatttacaatacgcatgcgaacgccgatcacattggcggaaacaaatatcttcaggggcagaccggatgcagcgtctatgtcccggagatcaactgtgagtttacaaagcatccggtgttagagccggcattcctctacggaggatttccgccggaagacctgcggcacaagttccttatggcacaggaaagcgatgcgtcgcttctgactgaggacacgctgcccgaaggctttgagatcattcctctgccgggacattacttcgacatggtgggttttcgcaccccggacgacgtggtctttctggccgactgcttatccagccgacagacactggacaaataccagatcagcttcatttacgatgtggctgcgtacttaaagacgctggagatggtgaagtccttaagcgggaaaatgtttgttcccgcccatgcggaggccgtggaagacattgcgccccttgcacagtacaacatcgataaagtatgggaaatagcagaaaaaatcacgtctctctgcagagaggcgctcagcttcgaggatctgatgcagaagctgtttacagaatacggtctggctatgaatttcgagcagtacgttctcgtgggcagcactgtccgctcctatcttgcgtggttaaaggacacgggcagaatcacggtctcattcgatcagaacaggatgcgttggacaaccatctaaagacaataaaagtatccccgccctttcggccttgctttacagctggccgaaagggcggggatatttttatttatttttcttttcctgcactgtatcgtctctgactctgtcccacagaaacgggtcctctgtcaactccagataatgcttcagccgttcccgaaatgccaggatccgcgcatccgcacagtccttttccacttccaggggattcatttcatacgggtcaagctctctgtcatagagaagctctctctgcggctcatcgggagtgtagccattggtgatgacgtaggtataccgtttgttcctgataccccgccagccataggctttgtgcgtcagaccgcgctttgaaaatgcggcaaccatgtccgcgcctccgggataggaacagatcagcatatcttccggttcgccggatactgcactgccggcctctgccggagtcgtggtcaaacttcctgcgtggctgtaaccctcgcacgtctccggcacctccagatccagaagctccagaagcgtcggcatgtggtcgggacttgcgaagatcgcctcattctttccgggctccagtcttcccttctgccggaaaatgagcggaatgtgaagcgcctcatcgtaccagatgttcttgctcataagtccgtgagatcccagcatctccccgtgatcggcggacagcaccaccagcgtgttttcctccatgccgttttccttaagccaggtcaggattctgccaaactgttcgtcgattccatgaacagcggctaaatactggcgtgtctgcatctctaagagaccgccctcttcccgcatggattccggcacattgggacggtagtgaacctttaaatccttaaacttttcataatagcgctccggcaccagctcataaggcaggtgcggcggattataggatacaaacagtgcgaacggttcgtcttcgtccttcttctgatccatatattcgatggctttgtcggtctcatattccgcggaccatttgccgggcctgatctgagtctcgtcattcagccagtagtggggatcgaggtgatcgtcgcacgccccgtaggacaggaaatagtcgaagccctgtcttctctctcccggcggcgtataggcgtcccactctctggcgccggacttcggatgcggactaaaattgagctccgacgcatccagatgccatttgccgatataacctgtcgcgaagcccgcgtcttttaaaacattggcgatacaggtctcctggggcttcagcatgatcttctcttccagaccgatcttgcagttcgtccacattcccacgcggaacgggtatttgcccgtcatgagcgaagcccggtgcggggaacataagggaaaggtgctgtacgcattggtacagcagacactttcctctgaaaaacggtcaatattcggcgttactgcctgatcgcttccgagagcgcctatggcctcagcgcgccactggtccgcgaagacatacaaaagattggttttcatcgatgtctcatctcctttaccagtataacttccaatccttcgaaagccgggtcagggcttccatatagaaataatctccccatgtattgcattcatccacaccgcggttcgtgcaggtattctccttggaatcccgtgcatacgtaccgtggagcagcagtccgttggatttcgtgatgtctgtgttggcgcagtgatccacgagggccttaagcatacggtccgcggccgttaaatagcggtcggccttttcctgatccagatactttgccatctccaggattccgcagacagcgatggccgacgcggaggaatccctcggttctgtgcttcccgtgtcgaaatcaaaatcccagtagggaacgagatcttccggcagatgttcgatgaagtagtccgtaacacggcagaataaatcgatgtattccgggttctttaaatagcggtagctgagcgcgatcccgtagacgccccatgcctggcctctcgcccatgcggaaccgttccggttgccctgatgggttacgccgtaagtgggctctcccgtctccacatcgaagaaatgggtatggtaggtggaattgtcgggtctcaggatgcatttcatggcggttttgatgtgatgctccgccttctgtgcgtaggactcatctccagtcacctccgtcgcccagtaaaggatgggaaggtttaacagacagtcgatgatcagccggtactccttaggctctcccggatttccccaggcctgaaggaagtttcctttctccctgtagcgctccgccagatgatcggccgccagaagcgccgccttttttgcgtgctcattgccggtcagcttgtaagccgccacacaggacaggctgtataagaagcccatgtcgtggtggtttacgtcgattttcttctcgattcgctctaaaaagctttccacctgaatgtcggcggcctttttaaatgcctcatccccggtatgctcataggccagccagatcgagccggtccagaatccggtggtccattccacattttccgtcggctcatagaagccgccgaagctgttggaggactgaaatttttctgtaaatacaggaaggttttcccggataacagctacggcgccgttaagcgccgtagttgtcatcccctcttccatgcccggataattccggattgtgttaagggtctgtgccataatcaattctccttattcttttcctttcattttaccccttaattccgctggctgcaacgccttccacgaagaacttctgacagcttaagaatacgatgacaaccgggatcagggaacagacggaagccgccatgatccatgcgtagtcggcgccatactgggaaataaacatacggatacctaactgaatcgtctttaattcttttgtctttaagtaaatgaggggtcccatgaagtcgttccacacattggtgaaggtgaagatcgtcaaggtcgccatcgccggttttcccagcggaagaacgattctcgagaagatgccgaattcatttaaaccatcgattctggcggcctcgcagagctcatccgggatactgatatagaactgacggattaagaatacgccgaatgcggagaatgcctgcatcaggatcagtccgatatgagtatcatttaagcccatcttggagatcagaatgaactgaggaatcatgtatacctgccacggaactgcaatagtggtaacatacatcaggaaaatcaagtctcttcctttgaatttcgtctttgtgaagccgtaagccgcaagacagctggtgaacagctggattacggtggtacagattgtcagcttcgcagtatttaagaagaaggtcgtaagcggaagctttttccagataatctggtaattgttccagtgtatggaatccggccaccatttcatgggaatggagaatacgtccttgttaagctttaaggaggaaatcaccatccagtagaaaggaaccagcatgaataaggacagtaaaactaataaaatatagatcaaacctttgtatgatttctgttttgtctgcataccgtttccctcctttacattaagtcctgagaccattttttctcaccggcgaactgtacgagcgtgatgacaagtacaacggcgaagagaatgatcgcgcctgcgcttgccggccccagctgccagctggtaaatgctttttcatagatgtagttgaccagggtcttggtcgcattgccagggccgccgccggtcataacgtatactaagtcgaataccttgaagcactggatcgtcagcatgatcaggacgaagaatgtggtaggtgtcagcatcggaatcgtaatgtagcgaagcttctgccagccgttggctccatcgatgctggccgcttcgtagagggagcttgagattccctgaagggctgccaggtaaacgatcatgtaataccccatgtatttccagatactgacgatggaaatggccaccatggcccagttcacatcgaccacccagcgggggggattggcaattcctatgaatttcaggaattcattgaccggtccgaaatccggctgaaacagcatgttccagacagctcccaccgccacgatggaggcgatatatgggaaatagattgccgtacggaaaatggcgattcctttcagcttattgtttaaaagaacggccaaaagcagagaaagcaccagggtcggaaggaccgtcatgagtgcgtactcgatggtgttccagaaggacttcatgaatatttcgtcctgaaagatctgagcgaaattggcaagcccgacaaactccatgggagcctgggaggcatcccatttcataacacttaatacaaaagaaaaacatacgggaatgaagatgaaaatcgcgtaaccgatcagattcggcagtatgaacgcgtaaccgaccatattatcgcggatcactcgtttctgacgcgaggaaaaacctttcttttttttctcttccatttattatacctcctggcttctgcactttttcccataagaaagagcgctcactataataagtttacagaggcgctctttctgtcatgggaacctgttaataattagttccagccctttatttctgctacacgtttgttcagttctgcaataccatcatcgatggagtaagccttgatcatgatcatctcatgtacttcgtctaatggcttacggatctcttcgatctgcggatcaagaggacggtcaaatgcgtaatgtgtataggttaaagcttccttgttgctgtcgccttccgggaaatactctgcggatgcgatggtgttgatggattcgtctgtctggatacctgtgaatacgccctgctcagcaagaatgttggctgcttcttcagaggatgcaaactttacgaaatcccatgctaaatctttctgatctgtgtaagcgctgattccgattggtgttaaagcacctacggtgtagccggattctgtatcttccggatgaggaattcttgctacgccccagttgaagtctgtctcgccttctgcctgagcctgcatcatggttgcgatgaaccagctgcccatcggcatcatggcacactgctgatttttaaatacagatgaataatgaatgttggctgtctttaatgtggagtagtcctgcatataaccattttcctgtaatgcaagtgcttcctcataatatggctttaagaaggagtaatctttctcaacaacggtgtgctttccgtcctgtacagcccagttggtaacgagcgcctgccatgtatggtcatgtgttccgtatacctttgcgcttccctcgccggaggtcatctttgctgccagttcgtcgtactctttccatgtcatgtcgttggatggatactctacgccggctgcgtcgaataaatctttgttatagtataatacgtaccagtctgaacggtacggaagtccgtatgtagtgtcgttatacattaactgctctgctgcgccgctgtatacggataagtccagactgtctgctttgatcatttcatctaacggaagcagctggcccttatctgccatctgaagcatggagcccatgtccttcacccagataacgtcaggatcggcctgagcagcggataagctgattcccagggagttgttgtactcatctgcggatgtgtcgattaccttgatctctacgtttggattctttgcttcatatgcttttactactgcggagaactgtggggttgtgtcgtaatcccatgtggttacagaaagaacctgcttctcaccgcttgcggccgctgtggtctcttccttgctctcagctcctgccgctgttgtggcctcttccttcgctgtcgtctcaggtgcctttgttgctgtgtccttgcttccgcatgctgcgagtgatgtgcataccataccggctgcaagtgtcagtgctgcaactctctttaacttcatgttaaaacctccctattcttgaatcacatttgtctgtgttcctttgatgacataagaataccagatttttcccttccgttaaattaacgatttttataattctgttactatttttctgatttgggaaaatggaaaagagaaaaaatataatatttgcagattcttgtatttttttcatatcaggcctttctggcaattgaaatcctgctgttttattagtatgatatccataagaatgtggagaaagggatggaatatgaataaagaagagagacagaaaaacgggaaaatgccgaagacatttcagaaaaaactgattttatataatatgctggtcatcatctgtatcgcaagcgcggtaagcttctataactatcgctcctattgccaggatgtcatcatcagcgagaccaataactccgcaaaccgtgtacgcaccctgtctgaacgcctgcaggttgcatacgatgagatggtgaatatcgtattaaactgcgcggagcgcaagtcgctgttcttcgccaccacgctggacagcccaaacaagccttataatacctccatgaccgtctacgcctccgatgtgctccgggatttctgtgccatctccggttacagcaggtacatcaataaaatcgttctctaccataacggtctcgtccttcaggccgggaattccttcggtgcgtccatggatgtggaaaacattatgaaagccccatggttttcctcccttttatacagagagaacgctcaatataccctctcgctggaggacaatccgttcaagtccggcaaaggccggcccacggtaccgaagcttcttccgcttctccggcccctccagtacagcgcacgcaacaagccggaggaatcctgggtctttttaggaatcacgcccaccctgttctccgacacgttaaaaagtctgccctcggatgtcctcgtatacgcggttaccgagggaggggatatcatcgcctccaccgacgaggaacaggaatttgatacctcccctattataaccagactcctggcttccaaagagcaggaaggcaattaccagatgaagctccatcacgaaaactgtgtgatcacctatacgaagcagccggtcagcggccttcttttctttgaaatccggcctgagagccggatgcagctggatcacggcgtcatcaggagaaccgttctgatcatatttttcttctgcatcgccatcgggctcactctctcacttctgatctcccgccagttaggcgcgcccatcagccgtctgacgaagcgcctggagctgatatcaaagggagatttcgaaccggatcactccattgagacggacgacgagatcggtatgatcgggcggcagatcaatcagatgtcgggacgcatctccaaccttttagagaccagggtggaaagtgaaaaagaaaaaaaggatctggaaatcaagatgctgcaggcgcagatcaatccccatttcctctataatacactggattccatcaaatggatcgccaccatgcagaaaaacagcggaatcgtgtccgtagtcacggccctctcctcgctgttaaagaacatggcgaagggcttcaacgagaaggttacgcttcgccaggagttggattttcttcagaattatgttattattgagaagattcggtatattgaactgtttgatatcgatattattgtcgatcaggaggagctctacgatgcgaggatcatcaagctgacgctgcagcccatcgtggaaaacgccattttcagcggcattgagcccagcgggcgcaccggtctcatcacaatccgcgtctgggtcaaggccggcgtcctgcacatatccgtcacggacaacggcattggcatttctccggaaaacattgaaaaactgctgaccgatacatccagaatcacccgcagcaatatgagcggcatcggtcttcccaatgtagaccgcaggtttaaactggtctatggcgaggattacggccttacgattgaaagtgtcgttgatcagtataccactattaccataacgctgccgctggaattttagaggctggccgcagggaggaaagtaaaatatgtacagagttattatcgtggacgatgaaccgctcatcctggctggtattgcatctcttatcacctgggaggagtatgactgtaccatcatcggaaaggccaccaacggcccgtctgctttcgatatgatcatggaactgaagccggatattgtcatcactgacatccggatgccagtgttaaacggactggagctggtggagaaatgcaaggatgaaggctgtaccttctccttcatcgtgctgacgaatttagaggaatttcatctcgttcggaaggcgctctccctgggtgcatccgactatctcgtcaagctggatttgaatgaggaagcgctcgccgcctccctggcgcgggccaaagacgcctgcgaactgcttgtaagccagaagcagcatcagctgctgaatgatctgataaaagacaatcaggagaatttgtctaagaactatttaagccagcttctgctgtccgggaatgcgccggaagtgccggataaggtgaaggaggagtatccggaaccattccttctcctcttttccgtaagtcccatcaatatcgcgtttgagacggatgacgatccttacgatttccaccagatcagcaaacagctgatggatatcctgggcggaatcgctaccagaaccttcctgcgccacacgcttctggagttccggacggatacgtacttactggccgcttccttaaaggacggcgatgtgtttgagacggttgtatcggagttctgtcagaagatggcggtggctctaaagacatatttcgagttcagcgccgtattcggtgtgagtacaaggaaaaaggagatcccgcttctcacagacgcgctggcagaggcgcagaccgcgctggaagtctactatttcgagtccagctctccggtggtcttttaccaggggcagaggtatcacatgagccgggcaaaggattttaatatcaatattttcaaaaaagatttatctgccgcgattgcgcagaatgacagcgataagctggcggccgtctttgaacagatcatcaccctgtttaaggaaaaccagccgggcaaggagcaggcggccagcgcatgcatcaacctctatacgtatctgtattcctatttcgagagtgcggacaacagctacggcgatatctttccttacgccatcaatgtggcggggcggctctatcagtttaacagcctggccgatatactgatatggcttcaaagcttttgcagcaagctctgccgcctgttgaatgaccgcaaatccacccgttccgacaagctggtggagcaggccagggcctatgtggacgagcattatatggaaaagctgaccctggccgatatcgcggacagtctgaatatcagcgccggccatttgagcaataccttcaaaaagctaaccggcagcaccctgtccgattatatcgccgcggtgaaaatcgaacatgccaaggaactgatcgatactcaccagtatctgatgtatgagatttcagatatgctggggttcgacaacccctattatttcagcaaggtatttaagaaagtgacgggaatctcgccaagagaacatgaaaacaggacgcctgcctcgtgaaaacaggctcataaaacctgtcacatataacctgtctcatataacctgtctcataaaacggcgggggcgtctccggtaccatacgttttcagtatggactggagacgcccccgctttttccgggatattgcagttagaggtcgtcgtcagcgcctgggatcaggaacaggaaacttttcttcccttccttgtaggcccgtttggccaattcctcacactgataggagtttaaggctttagcggcgatcgcgaaaacctgctcccgtccgtcttcgtaggcccggtatgcgtattttatctggtcttcctcagggagatctgaaaacaggatggaaaagaaagcgattttttcatcttgatacgcctgctctcctgtctcttttaagagattcccgtctgcctcatccacgagaatgctgaaaaatgggacctggtcatcctgataggcttttttcagatactggcgcctctcctctgtcgtcagaagcttatctgacagactgaaacagggaatattcttctcctgataagcccggtcgatcatcgtgttctgcgtcttcttcgatgctttttccagcacagcagaataatagtctaacttatttccttcataaaatttaacggccagctcatcgtatgtctcccgatagggaccgtccactcccaccacgaccggattcgtcatgataaagtttgtgacccactgattggtggaattctcttctgccttgcgttcctccagaatggccagacgaatggcttccagaacctccggatcctccgcatactgtttcatctcctcgataaaggacaccgtatatacgtctccggccgtgacctggcgggtcgtctggtacagggaggaatcgttgttccacgccagacggattccgtacttgtttgcgaaaaagcctgtgactttaaagctgtgccgccattttttgctttcgggattctccgagtcgttgagccaggcatcctttttctctgaacttttctgcaccttaaggcccgtctcctgcgctcctgccgaaaaaccgccgaggaccagaagtgaaccggttaaaagtgcggttatcatgagtgatgccatcttttgaattcttgtggtctttcttgtcttcataacagcctccagtctttctttaagcatatgggtattttcacagagcggcatggaaaccgcgtgtccggctgttccgtttgttcccttcagggagaaaaggagcgtatcgccgtaggccatccgctgttccgcggacaggccggaaatcgctttctcgtcgcaggaaagctcacacgcgtgatcgcattcccggcgcataaaatagacgagcgggttaaaccagtggatggagacagcaagctggatcatccatttatagagaatatccttccgcctgtagtgaatcagctcgtggcggaagatatcgtatagctcagacggcataaggtcgatctccggaagcagaatacagggctttaaaatccccgccagcatgggagaaaacgtttctttgcagtaatacaccgggatcctgcgccggatcttcagttccagcgccacactgcggcagattccggcggccgcggtgtcttctgcggacacagagaccgaccggagaagctttaaacatctgcggtacgcgaagatctggcggcagaaaatcagcagcgcagggataagccagataacccacagaaacgaaaacgcccgtgagccgacggcggccattgcaacaggattactgaaaggcctctgcggcccggaatcgcctgccgtgaacggttcttccaggtcagacatctcgtcatcgggctgcgcgtatccatcattcatcggtgaaacgggaactgtagaaaccggaactggagaaaccggatccgtagaaatctgatcttcgggagccatgacagcagagacgcctgcggccagacgctccgagccccaatcggcggcgcggccgatcatgccgggagccggggacagtggaatcagcagtctcaccacggccagcagccagatatagtactgccatgatttgctgaaccggcgtttccacagcggccggcacaggaacaggacggcgataatgacagaggcagataaagaaacggataagtagaggtaaaaaagcttctgcatcacgactcctccttacacttctcccagaaccgctgcagctcatccgccgcttcggagtccagctgcgcctgaccaaacagggaggtgagcagatgcttgacactgccgtcgaaatattcccgtacaaacgtgtgggcctgccctgacagatactcttctctcgtcaccgcggccgtatattcgctcattctgccgtggcgggtggaaatgataaatcccttttcaatcagacgggtgataaaggtgcgaatcgtggtccgcttccagccccgcccgttctcttctgctttttctaacagctcggcgatatagatggatccgccgctattccagataatttccataatttctttttccgcatcggacattccctgtatctcttccataaaggcacctcttttttattacatgatgtagtcatactttgatattacatcatgtagtcattaatgtcaacaccattgtggaaaataatggccggatgtacaaagggccggggcgcacaaaagtcgtcccggcctgctgatatcactgatatggttcagagaaaatatggttttttgttacagactgcagtatccgacgatctcacagtctgccggcagttcatacccgttcagactgccgatggcccactctgtcgggaatggacggcgctcgtcgagaaccgccgcaaaattcagcatgacagccccgcagtttaatctggcgtcgagttctccggtcatggagtccatcatcttcaccaggattgcttttccgtctgccagaaggaggcggaaggactggcggtttaaaaaggtaggcgcgtagcttgccgcatataaggcctctctgaggccgtcatcgatatacatctcatctaaatcggcttcttttccccatgcatcgccgtataccatctgtgcaagtgaaaccttcggggcaagatggccctctctcgtgatgacatccacatcggaaatacttctgatatgcagtctcgttaagcttctctctttttttccataaccaaaggctgtgacggccgccacctttttgccgtccccgatctttaacgccgcccggagcgccggatcgtcgtcaaccgtcagccagcagctgtcgagtcccaggtcggtcatgtgaagaatcatatcttcattcatatagccggcgttttcaagataccccggcttcacttccgacaggagaagtaagtaggccggcgcctcgaacgtaaggccttcgtatccggcattcccctgaagctggccgcattctgatccatcgagtataatcatgtctgtgctgatatctggtacaagacgcctgcattctgcgaaacattttgtgagtgctgctttcagttccccggatactggtttgtccgtaaattctctgattgattttctggcttccgccgcttttctgtaatccatattgccctccttgttttgtcattctttttttattataacactgcccttcctgtcgggcaagactaatgcctgcgcttctttccggaagagcccttacgtttggcaagcagggcctcgaattcttccgccgagcagccggattcctgcatccactgctctctgcggtgttttctcacggcagcgactctcgcctccctgattttctgcctttttaagaagaacagaataccacatacgacggcggccagtgcagcggcagctccggcagccaggagccagccgcgggacagattcatccggaaacgcccgccgggggcggcctggtctgacaggccttcgggaacggcggatctggtgagacggctcctgaccgcgggattgggggaaatccaggcgtgtccgaccgtccgctctccgtataagtaattgaccgtgaccacggttcccgacggagtcaggggcgtctcatcatagctcacaatgggaacgacggcagacagatccgcctccttcggcagcacgatccggctgttctggttcagcagaagaagcgactgatccgtattggaatccgagtaggtcagatgattctccggtacgaggctgccttcatagtcggtaagcttcatggactgaaagcggctgaaaccgaaatccagcagctttttcgtatcggtataatgtgtctgatggccgtttaaaatgacagcgatcagcgtcatatcgtctttctttgcataggtcaccagcgtgttgccggccagcgaagtaaatccggtttttccgccgaaaaccctggaatcataggcggcatcgttcttcttaagcatcttgtgacccggcgagatcgtctgtccctcgggagccttctgggagggcggaatcttatagactctcgtccccatgatttcaacgatctcggaataattcagcgccgcccgggcgatcaaggccatatcgtaggccgtcgtgtaatgctccggatcgttcaaaccgctgggattgacgaaattagacccggtacagccaagctcctctgccttttgattcatcagctttgcaaattcttccgtgcttccggccgcatgctccgccagcgcattggcaacctcattggcagaatgcaggatcaggccgtacaggctgtccttcaccgacatccggtctcccgtatccatgctcaggctcttgctcccctgttccacgttgtagaccgcattctgtgagaattccaccgtttcatccagtttacagcggtccagcactacctgggccgtcagaagcttcgtgatgctggccggataatacgcctcgttgatattcttcccataaaggatcgttccggtctccgcgtccatcaggattccgccatccgcctcgatggccacctcggacggccagtctgccgccccgtacgctgtcatgggcatgaggctcgcaaataccactgccagacagagtacaaaataactccaaatgttctttttatgccgcataatcaagtctcctgaacataaacatattcattttcaaaggaatattcttcccggtaacggtatcctaatgcatgaaattcctttagcccttcggcggtccttacgccgtttgcggccatgtaacgcaccatctcgcccctcgccatcttcgcggcggtcgctctcacacggacctttccctcctgctctgtgccgaagacacaggtgatgaaggtgtcggaagcggtaagccagggttccaccgcgcggctgtactctttcgatgcgagattgacaatcacgccatccccatctgccgtcagctcctcataaagccggtttccccagaaaccatacaaatctttctttccatcgaccgggagtctggcctgcatctccagcctgtatggaacaacgccgtcacatgcctttaaaacgccgtaaaatccgctgagtatccgtaaatgttccttcacatattcccactgggaaccggtgaaaatatcgggagccatggactggtactggaggccgacataagccagtacggccggtgtcaggctcctctctaaatccattgtctggtaacgctcgtaattctgccttgtaatcgcgtcattggcgccgaacagcttcttcagctgctccatggaatacgcctttaaaatatcgtgaagccgtttcgcatcctctaaaaaaacaggcatgcccgtctcctctatgatgtctgtctgtacccgcatcttcttggccggggatatgataattttcataaactgcacatggagactcgtgcctttagacatgagaggaattgtgcccctcctgactctttcgcaagctccttctcctttttgttttttagcttctcgaacgtttgtttgatttttacttctgattgtggtaaaatatattcagtccataatctattatgaggtataaaatctatgaaatctattactattactgctaaagtcaaactataccctacatcagagcagatgattattttgaataagacactgtccgttatccgggatgtgctgaactttgtctccgcattcgtttttggacaggaaggcatccgctatctcgaattaaaccatgccttatactacccggtcaggcagcagttcggactccgctctcagatgacacagagtgtatttaagaccgtccttgcaaaatataaatccatgaaaagcaatggacaccccttttcgaaagtatcttttcgaaacttcgagtatgatctggtctggaaccgggattactccatatcgtatcagtccgtcagcttaaataccctttccggcagattacatatcccctttgaatcgaaagggatggaacactggttttgttccggaggacgctttggcactgccaaactgattcgaaaaaacaggaaatattatctgcatataccggtcaccctggaagttgagaacaggaatatcttaaaccatatcgttggaattgatctcggcgtgaaccatttggcagtttcctttgatgatgaagggaacaccagattcttttccggccgcgcaatcaaggaaaaacgtgcaaaagcccttgccctgcgcaagcgcctgcagacatgtggaacaaaatcagcaaagcgtaagctgaaaaagctccgtgagaaagaaacccgttacgtaactgcggtaaatcacgcggttacgaaggcacttatctcacagtatggagcaggtacgctttttattatagaagatttaaccgggattcgtactgtcacggagcacgtccgtttaaaatcccgatacgtaatagtctcctgggcgttttaccagttccgggagatgctggaatacaaagctgcgctgtcgcattcagaagtccttgcgatagacccgaagtacaccagccagagctgtccggtctgcggtaatgcaacaaaggctaaccgtaacagaaagaagcatgaattttgctgtactgtctgtggttaccggagtaatgacgaccgtaccggagccataaacatttaccgtaaaggatgtaacactctgttcgcagaggcctgttaggcagaaccgaagcaggcgggctgccgtcaatcagcctattgtagccaatgtttgaggtaggagacatgaatcacatgtcgtactacgtgtagttgagttacaagcccgtgcctgggtctgccccacttcatcgggcattagacatgggtaattgactcgtattctccttgttgtatagtcgtaactattcagccgtgcagcggctcatcctgcagtaaatcgtaagcaatggcggaaaatacccgtattccttcttccagcaccttttcgtcgaaatcgaaatccgccgtatgctgcggtgcttccatggccgttatattccgcatgcagatggcctggccgccatgagactgaacacggttcatcatcagggaaatgtcctcgctgccccagtttctggcgcagcgcacactgctgacccggatatcgggaagctcccgctcaataaccgcagcggccctgtctgccagcgtcaaatcgctgtggtgggaatcggcggcgcccatgcagatcatctcacaggtacagccgtacatggccgcagccgcctcacagacacgtctggcgttctctgtcatatactcgttgatctcagtcgtctcccctcgcagctctatctccatttttgcgtaatcggggatgacatttcttccggtgcctgcgtgaagcgtccccacattgacccggctggcgccttcgctgtgacgcggtatcgccgctaaccccatcgccgcgcaggccgccgcaagaagggcgtttcgtcccttttcagggaagccgcccgcatgggccggtgcaccgcggtagatgacgtcgtacttggtggtcgcaagggagccataggtcgccggagtcaccgctccgtcatcggggccgtccaaaggcgcaagatgcgttccgacgaaataatccacatcgtccaaatggcctttggaaacgatggctctggctccccgcacgccttcttcggcgggctgaaagatcagttttacagttccgtgcagctgtgcccgcagattcatgagcacttccgccacgccgaggccgatggcggtatggccgtcgtggccgcaggcgtgcatgacgccggggcactgcgatgcaaagccctcccgcgccggtctgtggcaggtgttttcatcctccaggacgccgagggcgtcgatatcaaaacggagggcgcatacggggccctgcccgcagcgcaggattccgattaccccggtgtatcccgcctccatctcctctgtcaggtatgtaaggggcgtatcccagctttccctgaccagctttgtgtgctcccgccgtgcctcttcggatggaaggcccattctggctctgtcatccaccacctggcggccagtcagcacttcatagcccagattcgttagaatcccggcgatgacggcagaggtgcgcatctccagccagcccgtctctgggtgccggtgcaggtctcttcttagcgccacgcttttctcataaagttcctttgccataactgtgatctgatcgtacatctatcttcatctctcttctttcgtatttagcagttccctaaaagtttaacataggaaacatggaaaagcaattgaaggaacttccagttccgcgtataataatcttaagtttttataacgaaaaaattaggataccggaggcacttatgaaaaaaatactggttgtcggttccacctgcgtggacattatcctgaagctggatcatcttcccgtaaccggagaagatctccatccaaagagtcagaccatggcacttgggggctgtgcctgcaacgtggcgcacgtgctgctgtactccggctcacaattcaccttcctctccccggtcggcggcggaatatacggcagcttcgtcaaggaggcgctgactgcccatggttttcccatcccggtttatctccccgaaaaagaaaatggctgctgttactgcctcgtggaggcttccggggagcggacgtttctctctctgcacggggtcgaatacacctttcagaaagagtggatggagccttaccgcatggaagattacgccatggcctatctctgcggactggaggtggaagaacctacgggagaggcgctggtggaatatttcgagaaagagcggggcccgcagctcttttttgcgcccggcccgcgtggaatcagactttccggaaaccggctggaccggatcctggcactctcgcccgtgctccatatcaatgagcaggaagcgctggaactgggaggccgggacagtgtggcagactctgcggccgccctctttcagatcacgggaagtccggtaatcgtaaccctgggtgaacgcggcgcttactgccatgaaagcgcagaagtctcctattcggtcccaggaatcccttcacaggtcgtggatacgatcggagcaggcgacgcccatatcggggcggttctcgccagccttcagaaaggaaaaagcctgtacgattccatcgcggcagccaatcgggtggcggcggccgtggtgagccaggagggtgcgatccttccagaggattcggttttgtttagagaaggctgaaagaaaaaatcgacttttccatgacgcaaaataaaggcatcagagccgcggtatcgtcattccccgcagttctgatgcctttttataatcttctaatctgcataattctaatccgtatagttttaatccgcataagttcctttggatttcaccagcttcggacggtatcctgcctcggtgagcgcggccatgatggagttcttgtggtcggtgccgtaagcctccagtgtgatgcgcagttccacagccgagtttcggttgatgctgatgaactggttgtgttccagacggattacgttgccctgctctttggcgagaagtgtggaaaccttggccagctcgcctggcttgtccggaagcaggacggatacggtgaagactctgtctctctggatcaggccgtgctgtacgatggaggccatggtgataacatccatgttgccgccgctcaggatggagacgatcttcttgttttccaccttcatatgctttaaggccgctacggtcagaaggccggagttctccacgatcatcttgtgattctccaccatgtcgaggaaggaaacgatcagttctgaatcttcgatggtgatgatgtcatccacattctcctggatgtaggggaacagcagatcgccggggcactgcaccgccgtgccgtccgcgatggtgttgacaccgtttaaggaaactaccttgccctggcgcagggattcctgcatacagtttgcgcccgccggttccacgccgatcaccctgatcttcggattgagcatcttcgccagagtggcaacgccggtacagagtccgcctccgccgatgggaacgagtatgtaatccacggtcgggagttccttgatgatctccatggcaatggttccctggcccgtagctacgtccaaatcgttaaacggatggataaaggtaaggcctttttcctctgccagcctgtaggcgtaactgcaggcttcatcgaatacatcgccttccagaacgacttctgcgccgtatcccttcgtccggtttaccttcatgagaggcgttgtcgtcggcatcacgatggtcgcggagattccggccagcttcgcggcgtatgccacgccctgagcatgattgccggcggaagcggtaattaagcccttcgccttctcttcctcgctcaaggtgctgatcttatagtaagcgcctcttaccttataagcgcctgtatactgcatgttttccggcttgaaccagaccctgttgccggtctgggaggaaaaatattcgctgtacaccagctttgtctcctgcgttaccttgcttacaacctctgttgcctcttcaaatttctccaatgtcaacataacttacgcctcttctttctcttccacatggaataatgcattcacaaactcccctgcgttaaatttctgcagatcgtcgatcttctctccaacccccacgtatttgactggaattcccagttccgactggattgccacggcgattccgcccttggcggttccgtccagcttcgtcaggatgattcctgtgatatccgccacttccataaactgtctggcctgtgaaagtgcattctgcccggtcgttccgtccagcaccaccagcgtttcccggtatgcctccgggaactccttgtcgatgatccggttaatcttcttaagctcttccatcagatttttcttattgtgaagccgccccgccgtatcgcagatcagaatatccgcatggcgtgatttggctgcggccacggcatcatagacgacagcggccggatcggagccttcctgctgggcgatgatgtccacacccgcccggttggcccactccgtcagctgctcaatcgccgccgcacggaaggtgtctgccgccgcgagaatcacctttttcccgtcgtcctttaactggccggccagcttgccgacggaggtggtctttcccactccgttgacaccgatgatcagaagaacggactggcggttctcgtattcatacgcattttcccctaaatccatctgatcccggatgctttccatcagaagctccttgcattcggccgggtcctttattccctgttcctttactttctttcttaaatcctccacaatcgacatggtggtctgaattccaagatctcccataatcagagtctcttcgatctcctcataaaactcatcttcgatggctgaaaagccgctgaaaatggaatccatccccgatataatattatcccttgtcttttgcagtcctgctaccagtttcccaaagaatccctttttctcactcatagacggcctccttttacttatctaaatcttcttctatcagatttaccgaaacaagcgttgaaacgcctttctcctgcatggtaataccgtataaacggtctgcggccaccatcgttccgtgacggtgggtgataacgataaactgtgtatatttcgtcagtttatgtaaatattttgcgtatctgtccacgttcgagtcatctaacgccgcttcgatctcatccaacagacagaacggagacggttttaagttctgaattgcaaacagcagcgcaatggctgtcagggccttctctccaccggaaagctgcatcatgttctgcagttttttgcccggcggctgggagataatctgaatgcccgcctccaggatatcctcatcttccaccagctccagagtgccgcggccgccgccgaagagctccttaaacaccttgtcgaactcggtgcgaatctccctgaatttctcctcaaactgccttctcatgccggtgtccagctcctcgatgatcttaagcagcgtctcttccgccgtgaccagatcgtcgtgctgggtcttcatgaacacatagcgctccgatacttccttataatcctcgatggcgttgacattgacattgccaagctttttgatctcttctttcaaggatgcgatatgctttcggatctccggaagagattcctcctccccgctcttaagctccagtgcggcggaataggtcagctcatactcatcccacatgtagtttgccgagttttccaggcgctcctccagcttctccttctgactctgcaaacggaataaatccttatccagacggctcattcggtcggaaagctcttcccgcttctggaagagttccttctgctgtctcgacttttcctctctctctgccgtcttctccgcgatcacggcagagaggccggcggcacgtataacggtattctcaatctgtgcctttaatccggcgatttccgccagtttttcttcgataaccaggttggagtcatcggtgcccccggagaggccggaaagctcttcctccaagcggcggacgtcttccctgacccgacggatattctccagttcgaagtcatccttctgcttgagtccggacgcctccagctggacggtggagagcgctttggaagcgtcctcccgttctgccttggccgtgtcaagacgctcgtggcaggaatccagacggctgttgatatcctgattctgcccctccagccggatgacctcgcctgccagctcgttccggctcctgccgatctcccggatctgatcctccagctggctgttttcgcgttccagatcgccataggattcccggatctcttcctttttatcctcggtcctggaaatgctcatgcggaccgtattctgacgcagatagctctcctgcttcctggattttaaagattccagctcttcccggctttcggccagaagcgcctcgttcatcaccagatcctgttcgatccggtccacatcggtcagagccttggtgcaggctccttccagttcctcgatctcacgctttctgcccagcaggttgctggtgttcttaaacgcaccgccggtcatggaaccgcccgcgcttaaaagctcgccctccagggtgacgatccgcagggaatactggaatttcctggccagtgcaatggcgttgtcgatggtatccaccaccacgacccgccccagcagataccggatcagcccttcatactggccgtctgtctccaccagactgttggctagtcctaagacaccaggctcctttaacgccttgtcctgattgaaggtgtttctgttgccgatactggtaagcggtaagaaggtcgcccttccgtaccggtttttcttcagatattcgatcagctgcttcgccgtctgctcggaatccgtcacaatgttctggatgcttccgcccagcgccgtctccaccgcgatctcatacttcttcggaacggtgattaaatcggccacaacgccgtggatgccgtgaatgcggtctctgacctccatgacgcggcggatgcttccgccgtagccctcataccgttccgctatattcttcagcgattccagcttcgtatagctggtgtggtattcctgctgcctgtcgtttaaattcttgttcagacggcggacctcgtgttccagctcctccgtcctcgtctcagccgccgcctgggcgtctccgagactggcgatctctgcctcgatctcttccagctgacggtttaattcatctaactggccgtcctgctccgattcgtcgcttttgtattttaaaagcttctgacacacctcggaacgccggacatttacctgttccagcatggtttcgtaccgctgctgtctggcgttaatggaggccttctcgtttaaggtgtcgatgatgctgcccttgccggattcaatctcttcttccagcgcccggatctcctcatccttctccttaagcgcctcttcggccgcggccagacgctctaaggattccttaacctgggcggcaatgccgcatcgttcttcttcgtaggcggagaccttcgtcttcttatccgcgatttccccatggatcgctgtcattcgctttccaatgtgttccgcgttcatcttttccgtgttgatctgctcgttcagcacgcctacacggccttcgagggtgcccttttccatgttggtctcgctgagagccgttctggcctcgcctgcggctgcctccagcccggataaaagggcgtccaaggtctcatattccacccggatatgttcggaagcctgcctcgtatcttccaaatccttcgatacgatggcggccttttcctccgtctcctttaactggctgcgcgttccggcggtttccagcaggaactggttcacatcgtatttctttaagtcttcctttaaacgcagatactccttcgcggcctcggactgttttgccagagggccgacctgtttctccagttccgttagaatatcggtcacacggaccagattctgtttctcatcctccagcttcttctgggcgatggcttttctgcgcttgaattttacgattccggccgcctcgtcgaagagctcccgccgttcctccggtttaccgcttaatatcttgtcgatctggccctgtccgatgatggagtagccttccttgccgataccggtgtcgtagaacagctcgttgatatccttcaggcggcaggtgcttccgttgatcatatattcgctttcaccggagcggtagacacgtctcgtgaccgtcacctgatcgtaatcgatggccagctggtggtcagagttgtccagagtgatggcgacgctggcaaagccctggggcttcctcgtctccgtaccggagaagatgacgtcctgcatgctggagcttcgaagctgcttcaccttctgctctcccagcacccagcgcaccgcgtcggcgacattgctcttgccgctgccgttgggtcccacgataccggtgattccgttatgaaattcgaacacgatcttgttggcaaatgatttaaagccctgtatctcaatgctttttaaatacatactttatgttggcagacgtctatgcctgcctttccttttccattttcttaagctttaaaattccgtgataggcggctactgcttccgcagcctttttcgtccttccggtcccccggccgatctcttcctctccaatgagagcccgggactcaaagattttattgtgatcgggtccttcttcccgcagcagttcataggcaagcggtttttccgtctgactctgtacgatctcctgcaagatagtcttgctatcaaaaaagagctgtttatgctcgatgtcgttcatgataaatcgaaggataaactcttttgcattagcaaaaccaccgtccagatatatggcgccgatgagcgcttccatggcgtccgatacgactgaggcccttccgcgtccgccggtcgcctcttctccctttcccagcagtaagtaatttcctaattcaatgtcctcggcgcagtaggcgagcgtcggttcgcatacgatgctggcgcggatcttcgtcaaatccccttccggcttatccggatatttgtgatataaaaaatcgctggaaacgacctccagcacggaatcacctaaaaattccagccgctcattgcattccagcttgtttaagcggtgttcgttggcgtaggagctgtgggtcatggcccttgtaagcagctgcctgtccgaaaaacggtagccaatccgcccttccagctcattcagttttttgttcattgcggtcctctttcctttactatgaaagaaggtgttgcggacaggcggcataatgccgccctgcaacacccacatctattaattcagcgcgttcttaatctgttctaccgcatcaccgactgtagcgatcttctccgctacctcggacggtatctcgatatcgaattcttcttcgatacccatgatgatctggaatacatccagggaatctgcacctaagtcatctacgaatgtagaagccatggttacctcctccggttcaacgttaagtacctctgcgacaatattctgtaacttttcaaattccatcttttcccttcctctctcctattctttattttcctgattttcagcagtcaggctctctcttatcttatcattaatcccctgttctttaaaggccacgcattgaagaatggaattacacacttcctttgccttggaattcccgtgggttttcaccaccagaccgttcagaccgagaagcggtgctcctccgtactgagacgaatcaaaggatttcagtgtctccttaagcgctggttttacaagcagtgctccaatcttacttcttaagttcaccatcatgccgctcttgaccttactgatcagagtggcacctactccttcgtaaagcttcaggattacgttgcctacaaatgcctcgcatacgataacatctgcgccgccatgcggaatctccctcgcctcaatgcttccgatgaagtttatgtccctgcattccttgagaagcggaaacgtctccttaacaagtgcgtttcctttctcttcctctgccccgatattgacgatggcgacccgtgggttcttcacccccatcacatgttccatgtagatggagcccatacgtgcaaactgtaccagatgggaagccctggcgtcgacattggcaccgcagtcaatcagcagagacgcgcccttttcagtggggattaacggcgcaagcggaggtctttccacgccctttattcttccgacaatgacctgaccgccaactaatatggcgccggaactgccggctgaaacgaaggcatccgcttccttctttttcaccagattcatgccaaccacaatggaagagtcttttttctttcgtatggcattcaccggaggttcttccgtctcgattatctctgttgcaggaacaatctgtatctgttccgccggaaagttatgctttttcagctcctcagctactgccggttcctgccctaccaggagaacggagatctccctgttcgcgttcaccgcctgcacggcacctgctaccatctcagccggtgcataatcgccgcccatggcatctacagctacttttatcatcacaattcccctttcaagtctggcctaagataacctattacataatatactaaatattattctataaatcaatattaaatttaagaaataagagttccttataacggtccttcttctttccctgtctctcatcatagcagatatttccagttaaaaaaacccctttttacgaaaatatacccgcttttcacagaaaaaattccacttaccctgccgtgacggccacttaccggaaaagcgtggatattttcccaagcgtaccttataataaaaccagatgaaccggcgaccgctgtgcgcatggtaagagatcaaagaacagaaggcaggaggcggcagacatgaaaacgttgatcagagaaattccacaggaggaaccggagcacgcggatctatatgtgcaccgcagggatcaggcggttttgcgcctggcagaatacgtggagcaggaagagtttcgcagtgtcatcctgacgtgcttttgcggagagaaaatcgagaggattcccagcagtgagatcgattatatcgagacggtacaggaaaaacagctggtacacacggctcatggaacattggaagtgaggaagaggctgtatgagctggagcatcttctcccttccggcttcatacggatctcaaaatctgtcatcatgaatatggatcacgtaaaaacctataaaccgatggtgaacggcctgatggcggcggcatttacagattcttccgtcgtctatatttcccggaaatacttaaaggacgtgcgcagtcagatcatggaggtgcgaaatgaaagaaaatcaaaggaaagaacatcgattcaactgtaattttattcaggaagaaggtcttacagagattctgaagaaagggagtcttctggggatgatgatgtttatcagctcacttgtgacactgcgcctggcggctccggagggacttgagacattctggtcactgctccttgtaatccttctttcttacctggcagccggctgtcttctgcagctcatccgaggctttacgccgcagctggattcggcatggtttcggggagcggccgccgtgtcctggtgctatctcctcctgttcttcctctcttttctgacatggcgccttccatcgtttgtgcgcgccatgctgctgaccagcgccgcggttcttctgctgcttatggaggcagaataccgttatttgaagaaggtggcaaaggacttgaacagcagcgccgcgggaaggacgctcatcatcgatctggacgaaaagccgcgttccccggaagcgtttttcgatcttctggaaacctactgccggaaaagctctgttacgctggaatacgtaaagaaggacattccggccaccgtgaagcttgaaggccgcctgcacacggtgactcttacggagtcctacatgtacggcggccctgtctggtctatggaaatccgggagattttatgatgggaccgtgtcagcccatgctttccgtatccttgaagccattttctgcgaagttcgcatgcatcctcgctaacgcgctgcgcagaacaacgatctcatcccccggtatcccctgatactgaagctcatagatcttttcagagatcctgcaaagtgtggccgccaaacgtgcgcccggttccgtcagggcggccatggtcacccggttgtcctccggagcctttccggtctccacataaccggatttcaccagcttctttacgaggctggtaaccgtctgaggcgtcctgtcaatgtggcgcgccagttcgttcatgggcagctgtccatgcttcatcaactctacaataatggcaccgtgggaaggcacaatatctgtgatgccttccttcgccagttcttccgtgataaaacggcgtatctccccgtctatgcggctgatcagtgtaaaggtattgtcgatcattacgcttccctctgtttctttcccacatccagcatggcgccgttcagcttaagggtctcgccgtttcctctcaactgtctggcgcatgccagataatagtggcgggcattggcgctcgtctgcctccggccaagctcggtcagcgcatcggccttgagaccggaagctgcttccatttcctggccgcagtctaacaggagatcgcacagctctgcggcccactgcgcctctccgcgctccagggcggcctttccctcagccagcacctgaccggcgcctcccatcatcgcaaccgtcttttctgcccgttccttcgtgttcatatgacccagcttcgttggatttccgtcaaaccaccccagataaccggtataaatggaccggacagaccactccacggttccgtagtactcctgtaaatagggaagtgacgccaagtgctcaggaaggcggacgctgtcagccagttcatccggtgtccggccctcgttcatgccgtgaagcgtctctgtcagcacgtattccagcgcatcccggtaatttttaagcgtcgtctccacctccgcgcttccaatcacggctctggtgtggccgggaagcagataatcggccctgtactccctcatcttatccagggaatcgatccagccgctgatatcccggtactggccgccgcggatggcgtataaattaggccaggattcataatagttgtcaccgcagcagagaacgcggtgctgagggaaccagacaaagatctgatcgtccgtctccccgggggcggccgcgagtacgaccttcgtaccgtcgatttccagctccagcagctcctcctcgaagaactccctgcatggaagacttcctttttccccgttgatttcatttctcggcccgattcccacacagatgttttcctccggcgtcaagccgacgccgaactgtctcgccccgcgcacgccgcagatgtccttgatcaggccggtccttccatactggggatacgtcggctttctcccgataatccgcgtatcggggcctgcgaataccgacgcgcccgaggtgtggtcgaaatgaaaatagtgcgtgtaaatgatcgtccggacaggcttatccgtcagcttctcaaactctttcctgacttccatggccggtgcaacgccgtttaacgtatccaccagaatgcaggactcctcccctatcacaagtgtacacgtgctcccgccatatcccaaagcaaaatatacacggtcacagatcttcgtaatcccttttggaaatccgttttccgcctgtttttttaatttttcctcgccctcatagatcatggtttggcctctctttcctgatttacttcgatatcgaatgtttttcttttataatacttcgatatcgaagcaatgtcaacaaaatctcgccacttccttatttcacaggacccgcctttttatgaaggaaaaatactgccgccaggatggcgcagacaaattccgagacgaccggcgaaagccagattccgctctctcccaggagaacgaccatgataccaagagccgcagccaggaagaacagacctcttcccgccgacacggcaaaggactgccagggacgctccacggcggtaaagtaaccggccgacaccacattaaatccaagaaacaaaaacgacagcgaatagaggcgcagcgccctcatggtataggcaaacagttcaccgtccccccggtccagaaacgcgccgacaaagatctgcggaaacagttccagaacaaatacatagacaaccgacacgatcacctccatcaggagcgaatactttaagagcttccggcactgaccgaattctctgacgccgtaatggtagctggtaaccggctgcatcccctgggcaatccccgccatggtgttcagcaccagggtattgatataggaaatgaccgtatagctgacgataccgctctccccgatcacgcgaagaatgatctgattgaacaggaacaccacaagaccgcccgaaagctccgtgaatccattagccaggccgaggggaataatttttttataaacgcccggattccatttgaatctgcggaaacagagtttcttccgaaagcgtgtaaaatatgtaaagaatatgattgtggaggcgacctgagccagtccggtcgcgaatgccgctccccagacgccccagtgaaataccatgacaaagacataatccagaatgacattggtcagtccgcacaccatgacaccgatcgtcgaaacgacaggcgttccatccgttttcaccagtgcctccatattataggacaggataaaaaatacggcaaaggccccgatggttcccacatagctctttacgtactccaggttgtccggcgaggcgccgagaaacacggcgagaggctccagaaacagaaacgtgagcacggttaccacaagggagacaatagttaagacgaccagattcatggtgaacaggctgctcgcctcctcttccttcttctgtcccagcgcaatggaaatcagcgtggaagtccccgtcgccatcagcaggccgatggaaaaaatgcagatcacatagggcatggaaagattcaccgatgccagcgcgcgctcaccgactccccatgccacaaacatcccgtccaccatggtatacagtgcaaagatccacatggatacaatcgatggaattacgaacttgaaaaacttctttaacagcaagataaaacctcccggagggaactatccctcgtttttatagtgtctcaagaattgcgttcaagtaggagaggctgtttttggcggctgtttccgtatccggatcattcgtgatttccagtgccagcgcgccgttgtaccccacacggcttaaggctgccagtgtttccgcaaaattatagtgcgcatgccccggataccagcggttattatccgccacatggacgtggccgatggcggtgccggcgctttcgatggctttcccgatatcatcttcctcgatatttaagtgtaccgtatccaggtgaagcttcagccggtcagagcggaccgcgcgaagaagctctaatgcctctttgatcgtggttccgtaatcgctctcgaaccggttcatcacctcgaagcctaaggttacgccgtgaacctctgcttctttcgcacagagctttaagctctccgtcagatttcttttaaatgcttctccatcctgaccgcagtcggaaaaccttcccgcgatgagaccaatgataactataccatgaaatggagaggctgtcaccatgtgcccggtcaggcggcggatagccgcagcccgtttctcaggatccgagctgccgagacagattccgtctctctcgtaggcagagcctgtaccgatggaggtgaggaccacgtggttctcctccaaaagccggtataactgtttccggtcgatctgatccgagtcgtaaatgtgaagctccacggcgcagtaccccagcgcggccatctggggaatcgtctcttcaaacggtccccgaaacaggatgggatcatccccgcctgcggatatacttgccgtagcggcaatcgtcatgctcatgtctgttctccttccgtggtgaagcctgaatttccagttattttatcgatgttttccaaaagcagcggttccccgtcgcatccgcttatggagacgtcgttcagaaccagttcctgtacattgttgatgtagaggcccatctttgcagtcagctggatgtcatccatcatggcgggctcatccggttccgggttctcatcgtaatcaatggccacatggtcaaactccacgtaatccaccttcctctccggcagtccgtatataaatgctccggccacgtggcagttatgcgcctcaatgtttcggaaaatcatctgcttcaccgatgggggccgctcgtctgccggaagcggcgacttgcatttcacataatccgaatggcagtcgggatcacagcagttgtagtaggaattcaggacaaagggcgtcagaacatggtccatgcggatattttcaaaacagatatcttcgacgacggcgtcttttcctcttccacgtctcgtcttgatccgcagtccccggtcggtgtgcaggaacaggcagtctttcacatggacgtgtttcacgcccgctgccatctcgcttccgatagtcaccgccccgtgcccgttgttcatgcagcactggcgaatctcgatgttctgtgacggcactttgtatttatggcccatataatactttccggacttaagtgcaatgcagtcgtcgcccagggaaaaatagatgccggcgatttccagaccattcaccgattcggggtccatgccgtctgtattcggggaatcccagggatttaagatggtcaaatccaggaaacggagatcatctgagaaatagggatggatattccaggaagggctgttctgtacggtgaccccatgaagcaccacgtgatcgcagtggttcaaaaataccatacggggccggaatgcaatgattttcgccctgtcgtcctcccaccagtcctgaaaggtggcattcccatccaggattccctctccggtgatcaccacatttgagacatggattcccgtaatcatgcttgtaaagatatcgaggggatttccctcccaggatccgagattgtactccgctgtctcatcgtagctctgaatcataccgggaagcacgccgaaccgctcccgctctgcatggcccaggagcacggcgttcttcccgatatccagcgtgaagtcactctttaaaaacaggctggttacgagatacgttccctccgggataaacactcgcccgtctttcggacaggaggcgatcgccgcctggatggccagtgtatcgtcatggattccgtctccctttgctccaaagtgccgcacgttcagcgtcacaaactcatagtcggtacggactgaaaactccgcataaatctctccgccgcaccgcagggatacgcggtattccgtgtcgggcgtaaggcccgatacggtctggatgacgcggctgcctgttaagacgaaccggccatccagccatacttcatactctttttctgtatagaagactccgaagtcctcccattccagaaggaacttccgggaagtcttaaaaatcacgtttgctttcatattcttacccctttacaccgcctgccgcaatgccgtccacgaactgatcctgtgccaggaagaatacgatcagagacggaagcagggtgatgactgacagcgccagaaccttattccactcaaagcctgtctccgcatccgtcaagagacggagccccagggaagtcggatacttctttacactgtcgatatagattaacggtccctggaagtcgttaaacgcccacatgaactggaacagcgccaccgaaacgatggttggcttcaccatgggcaccacgatgtagaccagccgttcgaaggaattgcagccgtcgatctccgccgcttcctccagctcccgcgatacagaccgcatgaactgaaccagcatgaagatgaagtacggctcggctccgaagaaggccggaaccaccagcggcagataggaattcgtccatccccatgtccggaataagaggaactggggtatgttaagcactacctgcggcagaaacagcgtcgccagcaggatggagaaccagaaagtctttcccggaaactcgaaacgggaaaatccgtacgccgtaacgacgctggccaccaccgctccgaccaccttcggtatgacaatcttaaaggtattgatcagataaaggctgtatggattgcctgtcgcggtccaaccgtcaatgtaagcctgaaacgacggactcttcggaagaaagctgatggttgaataaatctcgttgttgctcgccttaaacgatgcgcccaccatccagagcatagggtaaaacatgacgaagcctaccaggatcagaacggtatagcgaaccacggtactgacctgttctcttgttttcttactcatctcaatcgtcccccttatctctcatcatccgagtaatacacccagtacttctggctggcaaaggagaccacggtcagagtacagatgatgataaacagcagccacgccattgcactggcaagccccatctcatacgtacggaatgcattctgataaatcaacagggagatcagcgtcgtcgatcccagcggtccgcccttcgtgatgataaatgcgctgttgaactcctggaatgcctcacagagctgtgtgatcaggttatagaaaataaccggcgtaataagcggtactgtgacggagaaaaactgtctccatttgccggctccgtcgatggaggcggcctcgtaaagctcctgcggaacgccctttaacgcggcgagaaagatcaccatggcggaaccgaactgccatacacgaagcagacagatgacgaagagcgcatagtgcgtgctgccgaggaaattaatcttttcaccgccaaacatctggataaactggttaatcaaaccgtctccctggaaaatgaacttccacacgactgcgatcgccacggaacctcccaggatagaagggatatagtagatggtccggaacattttgacgaatttcagcttaaaattcaagatatatgcgatgaacagggaaaatgccagtttcagcggcaccgtaagaaacgcatattgaaacgtaaccttaaatgcctttatgtatttcttcgtatgaaatatacttaagtagttgtcgagaccgacgaattccgttcccggcttaaataagctgtagttagtaaagctgtaaaacagggacatgataaatggataaaacttaaaaatcatgaatccgatgatccacggcaggatgtaaaaaaatcccctgtatttgcggtaaaaattcttccagtttcgtgtctttgcgggctgtgcttccatactctcactcctatcattccattttcatcagttcggccgttaccatcataagtacccccatggcctttacatcatcatcgactaccggttcagacaagtagtaggcgatgcttccatcccgctccgtgcgcggcccaaggcctgccactgcgcatgtgccggataaatggtatacgccgtcgtctgcctggtatattttctgttccagaacagcatcatagatttctcttccccttgcggcatacttttcttccagaagcgcccccaggcggcagccttttaagaccgcgtaagccaccatgagtgatccggaggtttccaggtaattcccctcctgctccggaagtgccggaagctggtagaaaagccggctctcctgatcctgatacgttaagatcccgtgaaccgcttctcttaaaagctcgccaaacctggcttttacctcatagatctcctcggaggccagctcgcaacagtcaacgagagccattagataccagccgatggagcggagccagaagttcggggaaagccctgttacgggatcggcccattttctgtccttgtactcgtcgtaagcgtggtaatacaggccggtcttctcatcgaacagaagcttccttgcctggttaaactgattcatgatatcgctgtaattcttcctctcgttaaaacggttttcatattccatataaaacggctgtcccatataaaggccgtccagccagacctggaagggatagatcagcttatgccagaagtttcctgtagtcaggcggggctggtagatcagctgggtcatcagggtatcgcacgccttccggtaccgctcctctcccgtctcatcatagagaaagtagaagattttccctgcgttgataaaatccagattgtattcttcacggtgatagctctttatggttccatcctcttcaatatagggactcaccatcttaacgataaaatccagatactcacggtctcccgtcagctcgtaaagacgggaggcgccgacaaataagcagccgtcctcatagttccattcatacatggactggccgtcgatttccaccagataatcgtcaagcccctcgtaatttttcatgtattctttaaaaaatggcatcagattcataaaatgacttctccttttttcgttgaatacaaaaaggaacgccgccccggcagcgcccctttctgttatatccgatcactcttattagtatgggttagccgcatttacgtcattgatggaatcgattaggtactgggccatctccgccggatctgctcccgcgcttaagttgtcaaatacttcgtaataagcgccggtacgttcctttaacgcagagttttcgaagttcggatcaaaggtatagtgacagaacgcaagcaccttctggttgccttccagagtctgtccgcctaagatatccgcatcctccagaatcttctttgccgccgtgttgcacacggtgccgcgctcggttcccattaatttaacgccgttttcattggaagtgatgtattccagaagtaaggcggcctcttccttgtgttcggaggtctctgtaatggcgaagccctgggaaaccttgctcatgccggctggattggaccccagatcggtcgggtagtctccaagtaccagttcctggccttcatctaaggaatcggcgatttcctggacgttggaatcgtattcggtcagtccggcatagtggccgtccatccacttcttgttggataagaagttttccgcaccgtctccggcgatcgtggaaatctttgggaatacgtggtcttcttccagagaattgatccattccatgccctctgtcacttcttccaccgtgtaattgacggataaatccttaatccattcttttccgtacttctcctgaaggtacattaccatccagatcattctctcgtagccttcctcagccagcggatagtaatcatcgccgagtttttcctgaaacgcctttcctgcggcgcgaagctcttcaaatgaggtgggaatggccacgccggccttgtcaaaggtggtcttgttgtacatcggaagctttcccgtgatggaaaccggtacgccctgaagctttccgccgacggtcatggccgccaggttggtctccgaccagttatccagggaaacaatgtctttaaactgatttaaatctgcgaatttggagccgtcagatgaaaactggtaaagccagttccagttgacctgcatcagatccggagccgttccgcctgccagctgggtagccaccttatcggtccagccatcccaggaggagtattcacattctacggttacccagggatattcctgttcaaatgcctcgacggccgccatggtcgccttatgtctcgtctccccgccccaccaggaaaaccgcagggtaacaggttcttttccgtccgtcgtggatgcgcctcctgcaacggtggccgcctcctgcgacgtctgtgccgtagtctgtgtcgtctctttcgcggcattgcccccgcatgccgtaagtgatgctgccattgccgcggctaaaaccgcagctgtcatttttttcatcatgatctttccctctccttttatcggttaccgcgctttttttgcttccagctcggctttcgtcagctcaatttcaaaccagacgtagtttacattttcatcctcttcgatttcgatggcatgctcaatatcggtcggtataaacgcccagtctccctcatgaagctcgatttcctcatccgccgcgcggtagatgaacttcgttcccggcattccgtaataccactgatataggttatcatggctgtgaggagccgccttgttcggtcccttaccgatgatagtgcccatggtcatgcgggtgaggaaatgggtatccagaatggaaagcgccttgatgccttccggacggaagccctcgatatattcgatacagccgcttaatggacagaatcttggcagcgcaatgtgccagtgatcaaactgctcgtaatcctccggaagcatgacagaagtcagctgtaaaaattccatgtctgttgcggcgtgtaagatattcgcttctttgtccatgtttgggataaacagagaaggttcttcgatattaaatgccttcttcggtgtggccacatagccttcgcccctggtaaagtagtaaatctgtgtctgatcgccaaaggtttccagcgtaactacggtaccggctgccactttgcatttgtaggtatgtacgccgtctaccatccccggaagcatctccgctcttaaaattccgtctcctgctgtctcaaatttcatgtcttcttttttctggtaatgaatcactgacatcttaaataacctccctaattatgtttcatataatctttccagagagattgataatcctttaaaacctcctcccggctcaaatcgccggtcagataaaagccccagagttcggcactcttttttttcagttccccgggaaggcagtttaccacgtcgagcgcggtcccgcctttcttgatgctttcctttacttcggccgccagaggggacagcccctccaggctttcgtcgttcatggccatgaccggaaggcagcccatcgtctctcttaaataccgggacgcctctgttgaagtggcgagccagtataagaattcctcggcttccttcggatgccggctgcttttcaccacagacagtgcctggacttccacgatcagcttatttctctccgcttcctcgtagaggggaatcgctccgatggagatatcccgttccagagccggtttggactttgccagaaccggcgcgagccagctgccctcgtcattcagcattgcgtatttttcaatgaagaagtaatctcttgcggtcggggctccggttgttaaggaatcccggtttccgaaacgcagggtcagatcaaaatagtccgccagcgcctgccagttctcttcatactcctgctgacggtcttcctctaacagggattccatatacgcggtgggattgtcctccgccatcgcaggaagcatgaataagttgcccgccatggtaagcagcgtttctttatagtggttcatcatgggctttatgtcctgttcctccagatccaaacataactgttcgaattcggatttcgtttcaggaaaacgctcccagccggctgcccttaaaagcttctggttataggcgataccgatcccctgaatctggagcggtaccgagtagaccgttccctccagacttcccatggtgcggtacggcatcggaagcttctgcagtacgttttgatcttccagcggaagcagatggtccttccactcttccatggaaccctcgaagccgacgtagataatatccggaagcttctgagacgccaggctgacccgcagcaaatcggaatacatactccggtccaccagattccattcgatgctcccgatctccgggtgctcctttctgtacagatccgacagttccttcacatatccgctccattcggaagacggcatgcttacggtaagtacaattcctggttctgcggctgcttctgccgcgccggtttctgtgttttgacttttgcatcccgctgcagccagcacaatacctgctgttattaaaccgattctaacccttctcttcatcgtaaaacactccccctgatgtgttgttgtcacagtattttttatagtataccatgacagttacaggggcggaaactaaaaataaccatcactctgtttcctggattttctctctctttctttgttgtgccttcattgtaatagaacgtgacttctttttacactcatgtttttgatatgataggaggactattttgacttcatggtctttcgcgaatttactgtttatggtagaatggtgccagataactgtgttttgggggaagtaagtatgaacagtcagcgttttgtcagtatccgaatcaaattattatcactgctctttatctgcattctcgttccgtttctggtatactggtttttttcctatgagtatatcaaaacgtcactggacgaggagttcgtctctcagacgaccgatacgatgcgcgccaccgggaacagtatttccgattacgtgaagctggtggattatacggcgcgcggcctctatttcaactctgaggtcatggacatcctgtcggaaaaggaacagtctgtatccagctaccgcctgcttcagacggagtcccgcatcttcgatttccttcagaccctttattccagtgtgccggatgcctcacagatccagctttccgcatttaatttaaaaaagtccctgctgctccagtccgatatgcagcggtatgaaaaggaccatatctatttaagccaggaacggcgtttcccatgcgaaccgtaccactcctatgtgacgtcagcccacatgcagtccaactataattttcaggagctgtcggggcgggaattttccctggttttttctctgcatatgcccatttatcagattccttccgtcaccgattccctgggagagattaccatcgacattcccatatcggttctggattccatctgctctcccctgttcaaggaaaaggagtacctctgcctggtggatggaaatggcagctatgtctacagcagcactcccgcagagatcgccacgcagacccgcaatccggttattcaggatatcctctcctcttccctggagcctggcgtcccgctggttctcgacacggattccgaggacatcgtcatttgcagccgcattctggaggatccggtggactggtatttaatcaagatatctccgaaagcctttgtctatgaaaaggcaagccgcttcttccatatgatgctttactcctttatcatcgtgactctggcggagattcttctgatcgtcataaccgtcatacgttttactgcgccgatccgaaaggtgacagcctatgcggaagccgtcagtgctggtgatctggatgccaatatgtcgtcctacatcacttacacgaaaaatgacgagattggctctctgctcatcacgatccgcaagatgatgtactccatcaaaaactttatcattcaccagtaccagctggagctggcaaaccggacaagtgaattaaaggcccttcaggcccagatcaatcctcactttatccacaatacgctccagtgcctggcgaccaatgccctggagggcggcaatctgcctctgtaccagtccatcacggccctgggacagatgatgcactactccatggacaccgctcacaatctcgtgcccataaacgatgcgctccattacatcgagctgtatttaaagctgcaaaagctgcgttttcccaacacgctggagacagaatttgacatatccgatgaggcaggcgccatgctgattccgaagatgacgctgcagccgctggttgaaaactcgatccggcacggtaatcttctgaagcttgacaacagccgcctgaccatacgcgcttttgtggaaggcaattacctccatttattcgtcaaagataccggaaccggcatttctgctgaaagactggaggagctcacgcactcgcttcagcaggtaaaggcagctgcctcctcatccgatgcggaaacctttgtcgatgcgctcaaccgtttttccgaagaacgtcccgcttccagaaccgctgatattcaaagtgaacagcagctggagacagaccgggaaaaccgatacgtgtcaaacaatatcggcatgcgcaacgtctaccagcgcctcctgttaaattacaagaaccagtgctccatggagatcagttctgatggaaaaagcgggacggtgatccatatccaggcagattaccggatgctggagcatcactgaatatcacagaagaatggagaaaatcatgaaagtcttaattgtagatgatgaagcccatgtcatcagggccgtaaaactcctggtgccgtggcaggaacttggaattacggaaacttacgaggcgctcacgccccaggatgcgatccgcatcattgaggcggaacagccggagatcttaatcaccgacattgtcatgcaggatttaagcggaatcgacctgatgaaatatattgcgggttccctgaagcatatcaaggtcatcgttatttccggctataataacttcgattatgtgagaagctctctccagcatggaggtgtggattatcttttaaagccactggatcaggatcagctgatcgaggccgtaaagaaggcggctgacgcctggaatcaggagcacgatttataccatacggctcaaatccacaaggaccagatcgattccatggccaccctgtgccgtgagaatctgctgtcgcgtctgattcacggcgaccatccggagcaggcctgcagaaaactgatggagctgtctcccgagctttcggagcttaccgcctgcggatttacctactgcaatctggaaccatttatatccggggaagaagcttcctggaacgagccctttcaccgctacagagacgcgctcgcctgctttctggccgattctggtgcgggctttctgctgcctgcggacagccgttatgagatcgctgtttttctcaccgattacagtccggcctttcaggagcaattaaagaattttttgcagtccgtgcggcagtcactgccgtttccggtctgcatgggggtggcagccggtatttttcccggaggaattatggagacgtaccagaaggcaagagccgcctttggagcctgcaatatggcgagcctctctcctgttctctgcagtctggagcccggtttccacaggccgttccatggtttgaccgaaaaacagaaggaagtggatgaccgaatgctgctttccgctctgctgacagggaatgagcagctgattgacgacagtatctctctctggattcgcagccgcattccggaagatgctccgcttcttgccattgtgctggaagcagttcaggatgaaaaccatctgtttgcctcctgggccgaactgttcgaaaaccgtcacaaaggattccgccatcagacggagtatgtggtcttaaacttccgcgacatcatggacggatcgatgcggatatcctttgaacgcttccgccgccgaatgcgggcggatatcctgtttctctatggggagctgaagtccattcactctcctgaggccgatatgatctatcaggtcgcacactatatcgaactgaattataaccagcctttcagccaggcagcgtgcgcccagacctttttcgtcaaccaggaatacctttgccggaaattcaagcagaccttccacgtgaccatgatcacgtatttgaatgatcttagaatcaaccaggccaggcagatgctgaaggatcccatgataaaaatccgccagatcgcccacgaggtcggtttcgaagatgaaaaatacttttcacgccagtttaagaaatccacagggatgacgcccaacgactacagggggcgctatcaggaacagctcggtgagtaaaatctgtatttgccggtaaagtaaaaggtgcagccgtatcaggcaattcatatgcctggtgcggctgcaccttttctatttccattatctgtccttatctgataaactcaatctttcccgcagtcacacattttccggacttgcggtcaaacagcagaatatcatttccttcaatatccacgcccgtcttctctccgatctgataggtaacgcctccgaagattactcctgtcagcaggaaatcgccgacgcgcagtttaacggtggactccataccggtaggcatggcgccgtagacggtggcctctaagcttccctggccggcgggactcagtttcaggcattccggtctgacaccgatgacaaagtcctcgtctgtgatcacgggatcgtcttccaccgcgtaatcgctttcgtctaccttcgcaatatggtatttaaaggtctcatctttatttcctttttccacggccttcttgtcttttaagacttcctgttttttcttctcggcctcctcatcagcctggttccgttccataaaccagcgatccatggaaagcggtttttccggcaggaatacggctttttcaccgtccaggacggtcagctccatggaaccatccgatctctgtctgccctttgcctccatgaagttgatggaaggattgccgacgaaatctgccacgaagagattgcgcggacggttgtaaacgtctaagggtgcctcatactgctggagtacgccgttgttgataaggcagatctttgtagccagtgtcatggcctccatctgatcatgggtaacatagacgaaggtactgcccgtctccacatgcagacgctgaagctcataacgcatctccagacgcagcttggcgtctaagttcgacagcggctcatccatgaagagcaccgaaggttcaggcgccagggttctggcaatggcgactcgctgctgctgcccgccggatagctctgccgggtaacggttcatgaacggtccgatcttgacgatgcgggagacacgtctcaccgcctgctccacctcttctttatggagctttctgttttctgtcagcacttttccgccgcttaccacggcgaagtcattgtttaattcctggcccttgcccttataggaagcacggagggaatccagctttgcctgaagctctgcggcctttgccttcgcagtgccgtccggatcagagctttcctgaatattgaagccgaacagtgtctttgctgtgtagatcgacagtgtgtaggcgtcgatcagctttaaatagaccttatccatatccagcttgccttttttgtcacggcactcttccaccagttcaccgattcgtttaccgctctttaaggcctggatcaaatcattggtggtctttgcctcgaaatcaatctgcggcagttcctccttgatgttgctgagtccaaaggagatgttctgatagacggtcatattgggccacagcgcgtagttttggaataagaatcccacttttcgtttgttggccggcacattaatgcctgcctcactgtcaaataccacccggtcgccgatggagatccggccgctggtaggtgtctccaaacctgcgatcatacgaagggttgtcgtctttccgcagccggaggggcctagcagggtgatgaaagaattatcttctatatcgaggttcaagttgtctactgcgtagaacttcccccatctctttgtcacatttgtcaattttatttctggcatgttaattacctccgataccatcgtccagactcgctccggtcagtttatttactaatgtattgaatatcaggatcgttacgatcaggattaagttgatggcgctggaaaatgcgtataagcccatctcgtcaaagtaatccagagtcgtggaaagaatgaagccctgtgtacagagaagcaggaataaggatagctctcttaaacacgtcataaacggaagcatgtatccgctgatgatggccgatttctgaatcggaatgatgatccggaacatcctcttaaaccacggcagatcctgaataatcgccgcttcctcgatctcattgctgatctgcagcatggagtttaatgcgctcctgctggcaaatggtatgtacttgatggtacctgcaatgattaacagcgtataggtgttgaataaattgatcttctcattggaaaagagaatgaagaacgccgcgcctactgcgatggacggcattaagtatggcaggaaagccattccgttcacgtagttggcccatttgctcctccggttcttcgataccgcgtatccgattaaggtaccgatcgttccggcaatcagtgcgcagcatatggaaacgagaagcgttccccagaaagcgtgccagatcgtggagttatataggattcccttctggccgtacattccgttttccgtgatattttcactggtgatccaccatttagtcgttaagttgcttaaatttctcgtgtacaggaagctgtaatctcccgggttcggaaggaaggtctccagtgcgaaggaaaggatcgggaaaatactcgtaaagaaggttgccacgatcatcacgataccgatgacatactttcccattttcccgagattgatcttggagagctggcccgatttaccggtaaccgtcgtgtaattctttctgctctttaaactcacctggttcatggtcaggatcgccacgccgaataccatcataataatggcaagaatactggcttcaccggtatacttggagttcatggagatatacttggtggaaagcgtcgtaaagcccagataatgcggtaccggataacttcccatggcgcttccgaataccagaagaacggtggagagaatcgccggttttaccattggaagcgtgattcggaacatggttttccatttcggcgtatcgagaatggtggccgcttcctccaggttggcatccatgttgcggaaaataccgccgatcaggatataggcgaatggcgcatagtgaaggcccaggacgaccgcactgggaaagagtccctggcatacccatttgggcgccagaatcccgaacagcgaagccaaaagcccattggacgttcccacaaccgcgttgctgttaaataagttctgccatacgaccgccagtgtccactgaggcattatgtacgggaaaatgaagatagagcttaaatacttcttgaattttaaattggtcctcgtgacaaggaatgcgaacacgccgccatagagaatcgagataagacaggtcaataccgctaaaagcagcgtattccataacggtttccacagattcgttctggccagccggctggtaaataagtcaacatagttgacaattgtatagccagatgcctttcccgttaaatgggcatcgatggttcccggatggatcatgagcgtatccttcacaattgccacgattggtgcaaccgttgtaaaagtcagcacaatgccgaacaacagaaggatgacattctgcggtttggaaaagtatgtcttgatcttattaagcacgatgaccttattgtttgacttacgattaactgtctggtccataactaactccttataaaatgggctgccgcattaagaacagccttaatgcggcacacccgttatctcattgctgcggtgacccgcttaagcttctgcgagtgatcgtttactgagcagaatcgctgtattttgtcagcagctcaatccagcttcctactgtaaaggatacgtccgcacagtattccggatcttccagaaccagttcgccgtcagtggtccaccactcatatcctctgtcgttcttgctgtcgaattcgttctcgcccttgtcattgtagccgcccttgctgtggccgtaaatcttttcggtctcttccataaccttcgggttagaggagtaaccgcccatatctttgccccatgcggagaatccgtctgctgtgttggtcatataggcgatgaatgcacaggaggtccacggaagcgggctgttgttggtcaggaataagtaatggcagtagccgtagccgccgatgcccttgtagccgtcctggtaggctgcaactttaatattgttgacggatacttccgaagattcctcaacggaacgaagctttgaatatacgagaagtccgcactggtctgtagcagtcttggataccagggtgttgcagatcgggccgtcatcggtctgttcattgtaattttctacccagagtttgatccatgccagggcgtaggcgccattttcaccgagtcccaaatcctgagcatcggttgccatctcatcgaccaccggcttgaaatacgcctgtttgctgctgtctaacgcatcatatgcctcttttaaccatccggcgtacgtatcttctgtcagcatgtataagaagttctttcctacaacctctgaatcaatgtccatgtataacgggtgaacaccttctgccacgaaatcccagcagttattgaattccgcatttccggtggaattgtacatgaataccttgttcagtgtctgcaatggaaggaaccctgtgtaagcgtctgctgtagtgccgttggcatctgcccattccttcggaataaaggtctttaaaataccggtctgaaccatcttggattcgatctggttgccatcctggatcagagtcatggcaaatgttccggaagactttaaagagtcagccgacagctgttcgaagatcttattattcttcggctgctgccattcatattccatagtataggaaggatcgatggactgtaagtattcgatgaacagcggtaaagcggtctttccacggctggagttgccaactccgtagaaggtctttccgttggactcttcgattgctttctttgccagctcttccatgctcatggactcggcctctttaatgatcttttccacttccgaaagatttgcgtcgtccactttcggttcctctgcttttgcttcggtctccggggcctttgtctcctcccccttcgcggcctctgtctgagccgctggtgctgcggtcgttggatccgccgccttagaaccgcatccggcaagtgttgccgccaacatggtactgattagaactgctgataaaatttgttttttcacttcttactcctccttcttatttcctgccttttcgatgctgcagcatcatctgatgtaattattatatctggtctcttcgtcattttgaactggacaatactgttattcctttgtgtattctgatatttttgtatatttttcctgctctcccattaaaagtattatatatattgtacatcacatagacataacagctgaatacgactgtgtatagtggcggtttttgccggctttaactgtttttgtactgcacttttatttataccgtttgttatttatgccgtttgttatttatgccgtttgttatttatgccgtttgttatttatgccgtttgaaaaaaggacatacctgtaaacatcgttgggtttaaaggttattatgcgctaatgcggttacgcttaaatactgccatacttttcgaaatcccccgcttatgctatacttgatacaatacagaaacaatctccccaacatttatttccaatcattatttccacatgaaaaggagccgtcatcccatgaaacattatatcattgtaaaattttctgaaaccgtcaaagagaaagaagccctgtatccggaaatagaagtcctgtttaaaaaggcagaaaaaatagaaggtatacaccaggtatccttctatccttccgtgattgatctgcctaaccgatacgatttcatgattttaatagagctggagcgcgaggcgcttgctgttttcgacgcttccgatattcaccgtgactggaaagcaaagtacggcagcttactcactgccaagacgatctttgactgctgctaaagcgccgaatggccttaagaatggccttaagaattcgcagcctggtattcggagggggtgacgcccgctattttcttaaatgtgctggagaaataagtgatatcgcggtagccgaccatctctcccacctcatacaccttatagcggcagttggtcagaagcttcatcgcctccctgattctgcaccgggttatataggccataacagtgtaatccgtctctttcttgaacagatggcttaagtgtccttcgctgattccaagagattcggcgatcgttcccacacttaagtcactgtcattgtaatgctcggttatgtaggcgattgcctctttgatataccggctcttatcacccgtcttgattccgggagaaagaatctttgactcctcctgacgttccttttcttcccgttcttttaccagcttatcgcgcaccctgctgactgcgtcctccagttcgccatcctcaaatggtttcagtaaataatcgaaagccagcagctttaacgcgtttctggcgtattcgaattcgctgtaggcggtcagaaagatgacagagacatggtttccctcctcccgaaggactcttagcatctcgatcccatccatcttcggcatccggatatcggagatgatcagatccgggttgtatttgcggcacgcctccaggccctcgaggccattggccgcctctccggccaccatgcagtctaaggacgcccagtccgtctccatgacaattccttttctcacaaatacctcatcatcaattaccaataccttaagcatctcataactcctctccctgtctgaccggaatcatgatggtcaccttcgtgcctccttcttccggcctgcagaccgacagcccatactctgcaccgtagtgcagccggataatcgtatccacattgtaaaaaccgatatgtcccagccggagcagatcttcctctccgccctctgacggtacgcccgctcctgctgtccgattatttaaatggttcagtacctcgtcgctgattccgcagccgtcatccatcacctctataaagagccgctcctccttcgaaaacgccctgacgaggatatggccttcctcacagtctctcagcccgtgtatcatggcgttttccacaattggctgaacgaccagtttcggaaccacacagtctgcaagctcctgcggaagctcgtaatcgaaacagaatttcccctgaaaacggatcttttgtatctccgcgtagcagtctacaagctccagctcctccttcagggtgataaactgggcgttggatatgctggtccgcagaatcttcgccagctttgccgccagggtggcgatctccgggatgtggttcgccttggcgacccatttcatcgtatccagtgtattgtacaggaaatggggattcagctgggcctgcatcattgcgatctgtacctcgttcagcttcttctgctggctgacctgcatttccatataggccttcaactccgacgccatggtgttgaagctgccggacagctggccaaactcatcattcctcgtggaaatgaccctcgcgtcgagatttccgttctgcaccttgtgcatggcctcattcaggctctggatcggacgcgacagatggttgctcatcttcgctgccaccgccacacaaagcatcagactggcggccgtcatgacgatcagcacgctgtacatggatttcgtcgtgtcagccgtaaataccttcggccgcagaaagacgctgtagagtcccgtcccgccgatctcagaaatatagatgctgttattatgaaatggctcatcaactgccgcgcccgccatcagtcggtgcctcagaaccgtcccgatctcctcacggaccgcggttcccgtactgtagaccgtttcccagaagctgtttaagatacagacgccatcctggctgccgtaagttccgcccaggattttttcaaaattggagccattgatactcacaagaacataccccacgctgctgtcttcggaatccaggatgggacgggcggcccgcagcagaatattggacgatcctgaatattccttctcacgccgtacggtcatctcgtccgggtgggcctccgccacctttaagattccccagtaaaccggaagctgggtatgaaacatgcctgcgccggtagagtagaggcagacgccctcttctgagtagagatcaaactgagccatctcccgcaggctggcagtctcctcgtacagcttcgcatagaccgcgcttctgccccggttgccggattccctgatggaagccgcaatctccggctcttcgctcagatgcagtgtcacctcatcgatggtctgaaacagggtggtcagcttttcttccatgacagccgcctgttccatatcttttttctggtagtcgcgttccagtttcactttgaacatctgaatcaggaagatacagctgaggaccagaggaagcagcgcgacggccacaaagcttacgagaagttcccgtttaaacgattttttgataaagttccacatggcgattcctctctaccggatcagttccgaccacagcgccaggatctcatcctgatgcgcgctggcccattcgagatcaaaatccatgatcttcatgtcttcaccggccgttttcatctgtaaatccttcctcactgtcctgcggcagaactggtccataatcagattctggacatcgtcgctgaccgtaaaatcaatgaacagcttcgcattgtcctcatggggagcccccttgaccagggcacagccatccggcacggtgctggtgccttcctccggataaatcatggtgatatccgcccctttggctatccgcttttttgctgtctcctccagtgtgatcccgacgagatgaattcccgtactgacctcatccacgacctccccggaaccggctgagacctttccatccagagcggatacaaagtcctccatgagctcccgctcgtccatgtcaagcacctgaatcatggtagcgagagccgtatagctggtacccgattttccaggtgccgcaaatgcgattttcccccgccactcgtcatctaaaaagtccttccagctgtgaggcgccgcctccgcacttaccagcttgttgttgtagataaacacgataggaagctccgtaaacgcggtccagctgtcatccggagacaaatacctgtcgtccagtttatcgctcagcttacagcggtacggctcaaaatactcccggtaagcctcatagctttccactccgcctccgaacatgatgtcacacgtctgctgtcccgcttcccggccgatggcctctaaaagctcggtggaaccgccgtccctcacctcgacccatatgccggtcctctcttcgaactccctgataatagggccgtatacttcctctttatgggaggtgtatacgatcagctttttgtcttcgctgactccgtaaccatccgcctgccgcctggcctcggttccggccgcggccgcgggaccggtttcttctgttttgctgcatccatataaaatggcggacagcaggatcaacagggccatacatatcatggtcctgacagcctgcttccgccgaatttgtttttccgatctgataaactcgtccataagtccctccccctggagcatcactttttccattataccatcttagggagagatttccaatatggactcatactcttattttctgtaatgttgatacactgcatacgattagagagactgcgggtgaaggcatgaaccggatccacaatccggcgcattaccaggtctgccacagccaccaaaaaagccgtttacccactatggataaacggctgaaggaatacgagtgaattacaggcagataccgccctgcatcatactttccgattatgcgcataccataagggtaacaaaataacacgctgtctataagcgttttcctgtcgctggtccttatggctgtgatgtacagataatcgaaacatgatggcttcctccttctctcttaactgactttattctatcatgttctatccaggatgtctatatcctggcagtatacaggcgcgggcgatcgactgagaggcggatttacgagatccacgccccgtcgctccccacataatacccatccggcgtcgtagtatttgcgagcatcgctccgctgtcgctgcagtagtaccatttggagttccactggacccagccggttaccatgtagccggtctcattaaaatagtaccaggcgttgtcgatgtactgccagttgctcacagtatagctccggtctgcgttgcagtaccaccagccgatgtcatcctttaaccaggccccgctaccggccgtggcccccggaccgctggcgcccgagctgcttcctgagctgcttccatcggagttgtcatcggagctgctgttggaactgatttccgcggcttctgcggaggtcacataccaggattccgactccttccagcttcccttgtttgaagaattgtagactccgcgcacctggaaggtgtaatatccgcctttcgttatgtagctgccgaagtggtagctggtctttgtcgtggtaatgacggaggtgacggcggtgcttcccctgtaaaggcggatctcatactttttagcttcctcattttcattccagtaggcggtcccatcctccgcatcccagtccaggccgtctacatccagatcgtactcgctctctccttccagcgcctccagggtgatcgagacgatgagagtgctgctggtacggctcaccgaagtgaccgtgccgtcatttccggttaagttgacgtctcccttcgaaaaaccggaggcaaagtagtaatcatcggccgcctccagagttaccttgatcttcggcttgtctccgtcctcccactcgtcggaaggttcattctttatctccacctcttccacataatacttgctggaaattgtggagaccgacacatctgctccgctgcttccgacttcaatatccgaggcgatccgaagggatacgccgcttatcttcgtactcgtggccgccatggctgtaaatggactggtcatcagtactgccgccaggaaaaaagctgtcactctttgcacaatacgcatatatgttcctcctctttctgttctgtaataaaagtaccacagaaagctgaaatatacctgaaagagacagaaaagatactggctgtatttaaccgcaggctacggaaagcagttccttccccagaacttcatacgtataatcgccgtttccgccatttacagagagaaagattctgtttccttctctccgtgcgcaggccgtcatcacggtttttccggacaggtccgtcacagccgatgcagcctccataccatcctccggcagatacagaaggaatttcaccccttctgcgtagttgtaatcaggcttttcgctgtttgagccaactgcgatcacacttccgggacggaccataagcggcagggagaagtaatcgtgggtctccttctgccagcgtccgcctgtcacggttttaccggtcagcaggtttacccaggttccttccggcagatagtattccacctccccggattccttaaagaccggagccgctaacagagaatcgcccagcatatactgtttatccagcgtctcgcaggcgcggtcgcccggaaattccacgaacatcggacgcatcatcggaatgccttcctcgtgagcctttaccgcctgaaggtaaagatacggcatcagcgcacatttcagcttaacgaatttccgaagcacacggcacgcctcctcgtcgaagagccacggaacccggtaggaggaggacccgtgaaggcggctgtgggaactcaggaggccaaactggcaccatcttttgtagatgtcggccggcgccgtattctcgaagccgctgatatcgtggctccagaagccgaatcccgcgcatgccagggaaaggccgctgcggatagtctccgccatagaagaatacgccgcagaacagtcgcctccccagtgtgcgggaaactgctggccgcccaccgtcgcggaccgtgcaaatactactgcttccccggttccgcgctcccgttccagaaggtcaaataccgcccgattataaaggtatgtgtaataattatgcatcttcaccggatcggagccgtcaaaatatgcaatatcctttaccggaatccgctcaccgaaatccgttttgaagcagtccacgcccatgtccagaagcgtcttcagctttgtctgataccattccactgcgccgggatttgtgaaatccaccagtcccattccggcctgccacatatccgtctgccatacgtccccgtttgtctttttcatcaggtatcccagcctcatcccttcctcgaatagcggggacttctggccgatatagggattgatccacacacagattttcaagcctctgtcgtgatagcgccgcagcatgccttccggatccggaaatgtcttcgggtcccaggtgaaattgcaccactcatacgcctccatccagtaacagtcaaagtgaaagacgtgcaggggaatgtccctgtccgccataccgtcaataaatccggaggtcgtcgtctcatcgtaattggtcgtgaaggaggtggtgagccacaggccgaaggaccaggccggcggcagagccggccggcctgtcagctccgtatatttggagatggtccctttgggcgtggagccgttgatcacacagtaatccaggcgttcaccttccacggagaactgtatacgctccaccttctcgctggcaatctcataggcggcatccccttcgttttctaaaagcacgccatatcctttgttggtaatgtaaaacggaatgtttttatatgtaatctcactggccgttccgccgtcttcattccacatctcaacagactgtccattttttatgaacggggtgtagcgttctcccagcccgtagacatactcgtccacgtcgagggccagctgttccaccatgtagcattttccggtctcccggtttgtcatgtgagccatattccgaaatccggtacttgtcagttcccggtcgccatccagaaaatggatcccccaggaatttggcctcttgtcgattaccgcggtcgttcgtccgcttcggtaacggatctcctcatcggtctcctcgactacggtgtgaggtgatgtcccgtaaatcctggcaaagggaccgcggcagaccgttccttcgaaatggctgaccgacacccggatgacatcctccatcgggctggtcagccggatcgtcagcatgcccagattcagacagtcgccgcggtctgctatgtgttttcccggcgcatagacgatcagttcgttatcgttccgtctgctgtccgcatactccaccgcataaagcggtgtcatctccttttttatacaccagtatccttctgtaaatttcatcgtgtccctcctgaaacggcgtcccgttttctctttcattctcttttattataagtaattataagcaccgaatataaatacgggaaggttgaaaatttacccaccccaaaagggaaaaatatgcattatttttgccaattattgaaaaaaatactttcaaactgagccgccttatactagaatagactgaagagaaaccacctggactcagaagcggtttcttcctgtccctgacggactgaattatgtatctatagatgagtctacatttgtgacagttcagacggctcatcttcttgaccgaaaaatccggtcaggaagcatcggatattcatccgatgtgaaaactggtgcataaagccgcttacaagtaagcttgacgctgcttcctgcgcccattttcccgccgtctgaactgttacaaacattttacaaggaggacattattatgtcacagagaacggatattcacaaagtactaattatcggttccggcccaatcatcattggtcaggcatgcgagtttgactactccggtactcaggcctgcaaagcgcttcggaaactgggatacgaaattgtactggttaattccaacccggctacgattatgacagacccggagacagcggatgtaacttacatcgagccattgaatgtggaacgcttagagcagattatagcaaaggaacggcccgatgccctgcttcccaatctcggcggccagtctggcttaaacctttgttccgagcttaataaagcaggaattctggaaaaatataacgtacaggtcatcggtgtacaggtggatgccatcgaacgcggcgaggaccgtgtcgaattcaagaaggccatgaatgaacttgggatcgagatggcgcgcagcgaggtggcttacagtgtggacgaggcgctgaagatcgcggaccagctgggctacccggtcgttctgcgcccggcttataccatgggaggcgccggcggcggtctcgtatacaacagggatgagcttcagacagtctgcgccagaggcttacaggccagcctggtaggccaggttctggtagaggaatccattctcggatgggaggagctggagctggagatcgtccgtgacagggaaggacgtatgatcaccgtatgctttattgaaaatatagatccgttaggcgttcatacgggagattccttctgttctgcccccatgctgaccatctctgaagaatgccagaagcgccttcaggaacaggcctaccgaattgtggaatcggtgcaggtgatcggcggcaccaacgtacagtttgcccatgatcctgtttctgaccgcattattgtcatcgaaatcaatccgcgtacctcccgctcctccgcgctggcttccaaggccaccggcttccccatcgcccttgtgtccgccatgctggctaccggcctgaccttaaaggacattccgtgcggaaagtacggcacactggatcaatacgtgccggacggcgattatgtggtcatcaaatttgcccgctgggcatttgaaaagtttaaaggcgtggaggacaagctgggaacccagatgcgcgccgtcggcgaggttatgagtgtcggcaaaacctataaggaagccttccagaaggcgatccgcagcctggagacgggacgtttcggtctgggccatgcgaaggatttcgatacgtacacgaaagaacagcttctccacatgctgattaccccttccagcgaacgccatttcatcatgtatgaggcactgagaaaaggcgcttctgtggaagaaatccatgagattaccaaggttaaggcctggtttatcgagcagatgaaggaactggttgaggaggaggaagcactcctcgcctgcagaggcggactcccgtctgacgagatgctcaccaccgctaaaaaagatggtttctccgacaaatacttaagccagctgctccagattccggaggaaaccattcgcagccgccgtatcgccatcggtgtggaggaagcgtgggaaggcattcacgtaagcggtactgaggacagcgcttactactactccacctacaacgcgccggatcagaacccggtcagcacagccaggccaaagatcatgattctcggcggcggtcccaaccggatcggccagggcatagaattcgattactgctgtgtacacgcctctctcgcccttaagaagctgggatttgagaccatcatcgtcaactgtaatccggagaccgtatccaccgattacgatacctcggacaagctgtatttcgagccgctgacgctggaggatgtgctgagtatttataagaaggaacagccggcaggcgtgatcgcccagttcggcggccagacaccgttaaatcttgcggcggatttggaaaagaacggcgtgaagattttgggaacaccgccttctgtcatcgatctcgccgaggaccgcgatttattccgggccatgatggagaaactggagattccgatgcccgagtccggtatggcggtggacgtggaagaagcgctggctatcgcggcaaagattggctatccggtgatggttcgtccttcctatgtactgggcggacgcggcatggaggtcgtctacgacgacgagagcatgatcggttacatgaaggccgcagtcggagtgactcctgaccgtcccattctgatcgaccgcttcttaaatcacgcgatggaatgtgaggcagacgccatcagcgacggcacccatgcgtttgtgcctgcagtcatggaacatatcgagctggccggcgttcactccggtgactccgcctgtatcattccgtccgtgcagatttctccggaaaatgtggagacaatcaaagagtacacccgcaaaatcgcggaagagatgcacgtggtcggtctgatgaatatgcagtacgccattgaaaatgataaagtatacgttctggaggccaacccgcgcgcttcccgtaccgtaccgctggtatccaaggtctgcaacatccgtatggtgccgctggctaccgatatcatcacctctgaactgaccggacgtccgtcccctgtgccgactttaaaggaacagacaattccgaactacggcgtaaaggaagcggtattcccgttcaatatgttccaggaagtagacccgatcttagggccggagatgcgttctaccggagaagtgctgggactctcccactcctacggcgaagcgttctataaggctcaggaggcgacacagaacaaactgccgctggaaggaaccgtgctcatttccgtcaaccgcaaggataaggcggaggtcgtggacgttgcgagaagcttccttgaggatggatttaagattgtggcaaccggcaatacctgcgaactgatccaggccgccggaattccggcgacgcgcgtcaacaagctctacgaaggacgccccaacatcctggatatgatcaccaacggacagatccagttaattgtcaactccccggtcggaaaagacagcatccatgatgacagctatttgagaaaggccgccatcaagggaaaagttccatacatgaccaccatcgccgccgccaaagcaacggccagcggcatccggtatgtgaaggaacacgggcagggagaggttcattccctccagtctcttcacagcgagatcagggataaagaataaccttacttttctaatgtaaaaattcaaaagcaccgataacggttgaaatcaatcgttgtcggtgcttttatgcttcggaaaaattgtttcaccggaaaactgcgtgcctcgtttttccggtttcaccatgtcttccaccatggagatcagcggaaacacatcgttgtaatgcttctgtataaacattccgtttcgttcctggaacagccgtttggccagcttgtcaacgactggtatcacgattcgttcatgctggcacagcatgggagccacgtggtctatactgcctgtcacctgataattcaggcagccgcagtgacagttgcagcggccgatgacggcacatcccttacactcctctttttccagttcattgcgttcaaacagcttcgtacgctttttctcatcgattccgcccacgacatccccgatcgagaactctctgtgtcccacaaactgggtacagggatagaggaggccgtcaggggcgacggatatctgttttctccccagctcacaccgttcgtggcagtactgttttccctgtatatggctggctatcttcacctcaaaggggctgaaataaaatttctcctcccgcttcgtcagttcatagtaaaaatcagccagttcccggtactggcgtcttaattcgcgaaccgattccttcgtccagttccccgcgtaattcaggctgcagatgaagtaatgaaatcccttctgccacagctccttcaccccctgcgcatactctgccgctgtttccggcgagacggtcatcataaccggcgcataggggcgcgaggccaggagcatgtccgtcacggcttccaggcggtcatacgtgcccgctccgccgtgatcccgcctgaagaaatcgtgagccgctctcgttccgtcgtgggacagagcgataaatatattctcttttcgggaaaactccagaaattcccggtccagcagcgttccattggtcgtcatcttaaaatgaaaccggactggcctttccctttccatggccctgcagtatgccaccgtatcgcgaatcgtatcgcagcacaaaagaggttcccctccaaagaatataataccgcaggaaggctctccggaagcggctgccagacggactgcgtgttccgcggtggaacggttcatatactccggtttctgacatacgtagcagtaactgcactgcaaattacagtcattggtcaggtgcagggtcatatgcatcagattaccccctgtcccttcagccagtctatgaagtcccttacctgcgcctttaaattctcttcggcagctgcccgtgccatctcatcctgctcttctgacatggccgcccagtagtttccctctctgtcttcgtacttcttctggattttattgtattcttcgatcaaatcgccgtagtcataaggatcatagaatattcctacgacctcttcaggagaggccatttccaggcttttttgcagcctcaccgcggtatcctggatcgcatagccctctacggttgcatatacgccttcttccgtctcattccagtttccgacatctgacttggacacgaactctatggcgatctttttatcaggatcccagccatctgtctggagactgcctttcaccgttttttctttcgccttttctgattcgggatagatatgcgtgacgggaagctttacatttttcaactccggcgcggcctcctgtgtcagtatgaggccgccgtagctttccgcctccgcccgtatgatctcaaatgcctcctcttcagacagaaagtatggcgaaacgaccgcaacacagccgtaggccccgcttccaccgccgtgaataaagaccggagcgacccgatcagatgctccctgggcgccttccgcgcttgcaccgcagacgcttaaggatacagtcagacctaatgccgtcataacgtatgcgttcttttcccatctggacggaattcgtctcagcagctgcggatccgccagtatctcctcttttaccgggtatccgggatttttatatctggttaccgtttttaccttcatcgctcatcctcctctgcgggaattcgctgtgtgcttcctctgtgtgcttccgcgtccggttactgttttctattagaaaagtataccaaattgtccggacgaaagcaacatttgtccgatgaaggaaatcagtacggtacctccgacacaggaaagagcaaggcttcttaagtcttccccaaaagccttgctttttcctgtgtcttcaataatagaaatctgctttgacgatccccggacggaaccatctcttccttgtatatcagtttagcgtagcctgaatcagcttctcatggctgtgaggctccgccagttccagaacgcggtttaagtcaaggcccatggcctccgtgatccggatgccatactcttcatcggcccagcagcaatgaacggcatggcggtatttgatattctccgtgacaggcgcaatatttctcgcggtgttgccgatcagcagctcccgcttgtcctctttcagtactctccacaggtcgccgcctgcccggaagcagtcgtctgtaggatcgtcctgaggatcgtaggcatacatcgccccggataaatccagcggcggttccatgacgtcaggctgagccgcccagtctcccatgctgttcggtgaataggcgggagcgccgccgtaattgccgtccgtccgcatgagtccgtctctgtggtaatcgtgaacttcgaccttgggacgattgaccggaatctgattgtagttgatgccaagacggtatctctgcgcgtcgccgtagacaaataaacggccctgcaggaacttatcaggtgaaaaaccgattccaggaacgacatgggccggtgtaaacgcggactgctcgacttctgcgaaatagttttccggattgcggtttaactccagcacgcctaccttctgaagcgggaattccttatgacgccagatctttgtgatatcaaacggattttcataatgattcctcgcctgttcctctgtcataatctggacatacatagtccagcgcggatattcgccctttacgatcgactcatacaaatcacggccatggctctccctgtcttttgcgatcagcgccccggcctcttcgtccgtcaggtttttaatcccctgctgggtaataaaatggaatttacaccagaaccgctcattgtctttattgtaaaaactaaaggtatgttctccatagagattcatatgacggaaagacgcgggaattccgcggtcagacatcacaacggtcgtctgatggaacgtctccggcagcagcgtccagaaatcccagttgttctgcgcagagcgcatgccggtctgaggatcgcgttttaccgcacggttcaaatccgggaaattatgtacatcacgtaggaagaaggttggtgtattatttccgaccagatcccagtttccttcttctgtataaaacttgatcgccacgccgcggatatcacgctctgcgtcagccgcgccccgttcccccgctaccgttgaaaaacgtacgaaaagatctgtttttgtgcccttctgcagcacctttgccttcgtaaaagcggagatatccccggtacattcaaaggtcccataagcgccccagcctttggcatgcatacgcctctcaggaattacttctctgtcaaaatgtgctaatttctccaaaagccagacatcctgcatcatgacagggcctcttggacccgcggtcagcgaatgctcattttcagcgacaggtgctcctacttcattggtcagttttttcgcttttgtatccataagtacctccttctttcataattttattatattcctacatttcccaaaagtcaaaatatatttgtatacattgtatataaacacacctctatatgtgatatataattgtcaaattgcacaatgcctctttataaattcaaaatcatcttctgacagggataatcaaatacaacgagttcctccgcatctgtaaacccgcaggaatggtaacatgcccgcgccgcgattccctttggatcaccgccctgaaacgtaacgacagagacctgatcgccggctttaaagcactctgccatctttcgaatcagcccttttgccaccccatttttccgataatccggatgggccgccagaaacgtgagttcttttcccgcctttgtgaatagaatcagacctgccgacgtgccgttcctgtcgtctataaaagcctcgttcttaccgattgcctcactgagtgccgccagaaaatcctcttccttatatccggcgaaatcatctttcaccaattccatcatagacagaatcatttctttatcttcctgtagtacgtatcttaccatagtccctccttctgcctgccaatcctctgtattactacacagtagtttaacacaggcgaccgtcagcagcaacagataattgagccgggaaagtgctcaggattccaatgggattcccaagtgtatgccagaaaaaaacaatcgttcgtgttcgcgatacaaatacacttcttttaaaaatgtccgtccaatacggaatatttttcttgctatttgtcctgccgccccttataatgtaggtatcagatacacggaaacagtattttccataatcaagcagtgtaaagggggtaatatcatgcaggaacaaaccatgtgggcattgacgaaaaagaaagcggaggaagggctctggatggagcgcgtgccggttccggccgttggaccgaacgatgtaaaaatcaagatccataagacggccatctgcggtacggacgtacacatctatcaatggaatgactgggcacagcacaccattccgatcggcctgaccgcaggccacgaatatgtgggcgagatcgtggagacaggcgcgggcgtaaccggacatcaggtgggggatctggtatccggtgaaggccatatcacctgcggtaagtgtcgaaactgtctggaaggccataaggaaaactgccgggatgcaaaaggagtcggtgtaaatcgaaacggagcgtttgcggaatatctggtgattccgtcctccaacgtgtggccctgtaatccaaatattccggaggagctctactccatcttcgatccgttcggcaacgccacccatacagcgctctcctacgaccttctgggcgaagacgtcctgattgccggggcaggccctatcggtatcatggccgcggccatcgcaaaattctgcggagcgcgccatgtggtcgtgacggatttaaacgattaccggctggatctggcgaagaaactgggggctacaagaacggtcaacttaagaaaagagacgctggccgatgtgatgaaatccatcgggatgacggaaggctttgacgtgggcatggagatgtccggaagtccggccggtctttccgatatgatccataacatgaagcacggcggtaagattgcgctgttgggactccagggacgggaaaccacggttgacttagagaccgttatattcaatggtctgaatcttcgcggtatttacggcagaaaggtctgggatacctggtataagatgaccaccatggttcaggccggtctggatatatcgccgattatcactcaccggtttgatatccgcgattacgaaaagggatttgaagctatgatttccggacagtcgggcaaagtaattctggactggtcccatatcaatgattaaggaaaaggagatttgaagatggcacgcaaaaacgatattttaagtatttatacgaaagaagtggaggacatcagggaagccggcctgtttaagggagaagcaccgatcgcttccgcccagggcgcccgcgtaaagctggaggatggccgggaggtcatcaacatgtgcgcgaacaactatcttggccttggcgacaaccagagactgatcgatgcagcaaagagaacgtacgacaaccggggctacggcatggcttctgtccgtttcatctgcggaacccaggacattcataaggaactggaagcaaagatttccaatttccttgggacagatgatacgattctttactcctcctgcttcgatgccaatggcggcctgttcgagacgattctcacagagaacgatgcggttatcagcgacgagttaaaccacgcttccatcatcgacggcgtccggctctgcaaggccaaacggtatcgttacaaaaataatgatatggccgatctggaaaagaagcttcaggaggcggatgctgccggagcaagaatcaagctgatcgccacagacggcgttttctccatggatggaattatctgcaacttaaagggtgtctgtgatctggcagaccagtaccatgcgctggtcatggtggatgacagccacgcggtaggcttcatcggaaagcatggccgcggaacggcggaatacaacggcgtggaaggccgcgtggatattatcactggtactctcggcaaggcactgggcggagcgtcaggcggatacacctccggacgcagggaaatcatcgatctgcttcgtcagagaagccgtccatacttattctccaacactctggcccctgcgatcgtcggcgccagcttagagctgtttgacatgctggaggaaagcacggagctgcgggatcatcttgaggaaaccaccgcatactacagaaagcagctgacggacaacggattcgatatcattccgggaacccacccttgcgtgccggtcatgttgtatgatgaaaaactggctggagaatttgcaaagagaatgatggcaaagggtgtctatgtcgtggctttctcgttcccggtcgtaccaaaggggaaggcgagaatccgcacccaggtatgcgcgagccatacaaaagaagacattgattttattgtaaaatgcttcatggaagttcgggaagaaatgggccttaagtaaagcggatattcggtctgcagccgtaaggatataaggaaaaggaagtgatttcggcaaatcacttccttttccttatatcatgccctcatatcatgtaaaattacaatcctattcccgcaatccttttccttctctcaaggaatagatcccataggaaatgctttgaatcaacatgatcaggcctaacagcaggatcgacatactgcctgttcccatgtttatctttcctataaatgcgatcacaagtccaaacaaaagtgaatgtctcgttatctgaaatgccttatagccgcagcggtaaatctgcagccgttccgcttcatcacagctctcttcccacgtcctcaaaaaggacaaatccgcaggatctccctttttcagtggattcgtctttttcacctgtttgataaccgctatttccacacagaccatggagattgtggatactaaaaatacgaccacagacaaaagcgcaaatgtgtttctcttatcgaatcctatgccgaatgccataaactgaatgaccaaattgacattggtaagagtcaaaacagtattctgagcgttgcctacctttttctccgttacgccttcctcatcggaatccataaggggggaccactttttcgccttgttcatcaaaaccagagagcagcctcccagtaccagccagactatcagctgaatccataaggcagaccgcactgctcccacatacagcagttctgccagggatgcagcccccccttttgcaaataagatggatccgactccaagccctgctccgatcgccgcccctgacaaagtccacagcattaattttaaatatgaatttttcactttcattttgtctcctcctcttcatacgcaaaaatgtcttccactgtcacggacagaatccgtgccagcttaagcgccaatgtcaccgagggggagtaatcgccccgctcaattaagctgatcgtctgcctggacacacctgccagattacccaactccgcctgattcacgccgagccttgcccggtgttccttcaacctgttatataatggcatagttctcctttccatatgacaattaccatttgcaaattgacaactattcttgtcaccttagtatagcattgacaactttccttgtcaatatattttgacaacaatatttgtcagccaaccgctgcatttaaggaacagatcccgttatcaatgaatcaggaatacagcggatcaggaacacagtgaatccggagcatacaaaatgggctgacggttaaatatattttttaaccatcagcccatctcttttatcagattaccgttttatttatcagattacaggcttatcccgtccgaaaacctgatcaggcatgcaatgctctgattaacgcctctgaaaccaggccttcatcgtatccaataccattaccagctccgcctcctcgatcacatacggaaccatcgcgtacagatatctcaaaaacggacggctgaatacgccccgttcaaatgcgaactgctggtatccctccaatacagccggatcgaagacctccacacagacgcagccccccatcatgcgcacctcttttatgcggctgtcctcgaagccctccatctctctcctggtaattgccgcgatccggctgattttcgccatatagtcttccgactcgaaaagttcaatcgattttaacgccacgctgcaggccagggcatttcccataaaagtagggccatgcatcagcgccagggagggatcatccccgtaaaagccctggtataccttatggttcgcagccgtcaccgcgtgcccgatatagccgccggtcagcgcctttcccagcaccagaatatccgggcataccagatcggccacaaaccggtgccctgtccggccaaagccggtggccacctcatcgaagatcagaagcacatcatactcatcgcacagctctctggcccgctttaagaaagatatgtcgtacataagcatgccaccggctccctgcagaagcggctcgacgatcaggcagttcagttcgttgtgatgaaggtgaaatgcttcctccagcgccggtatttctgtcggtatatgaataacattctttttctccccgaaggcgaagtggtaatcctcatcgtctcctacttccatcgctttaaaggtatcgccgtggtaagaatgagtcagagacaggactttctcccgtctgatattccggtttgtatagaattgcagcgccattttcagggccacctccaccgccacgcttccggagtccgaaaagaagcagtagtctaaatctcccggaagccattcttgtagtttggccgacagcttttccaccggttcatgggtcagtccccccagcatgacatgggaaaagcagtccgcctgagacttgaccgcctcggtcagcaccggatgcttatatccgtgaatcacgctccaccaggacgatacagagtctatcagtttccgatcctccgtataaagacagacgccctccgcgttgacaatcctataaggcggtttcatcgtcttcatctgctgatatggataccagatcatatggatacctcctctcccggctcatataatgacgccagcgcctctgcctccatggccagctccgtatcgccgtctttgacacaggccagcacggtaaggcctgtcagcaattcacacatgttccgattgtcctcttccatcacatctccggcatggaaatggttgaaaataattcctttcacaggaatattccgggcgcgcatgtatccggccgtgaggaccacatcgttgattgtgccgagccccgcgtctgcgacgatcaggcaggccagtcccagttcccggatcacatcttccagctgaatctttgcttcgttgtaacagaggggacagaggatgccgccgctgccctccatggtgacgtattcatacttccggcctacggcttcgaagccctctttcaccacctgcatctgcaccggatttccctcaagccgcgaggcaaggtgaggcgaaaaggcattttcatagatgtacggacacatttcctccaaaggctgtccgataccggagactgtctttacatacagcgcatcccccggtatcaggctcccgtcttccctgcgttcatttccgctcatggcagctttatagtaggcggcgctgcgtccgctctcatgcagttttttgacaatcagaccagtcacaaacgtttttccgatatccgtcccggtcccggtgataaagatatttttactcatcgtccaattttacctcgtatccaatgtttttcagcagttccatatccgtctgtaccgtaatccctgcggtggtcagcatatctccgcttatggctgcgttagccccgctcttaaaacacattttccctttatcctccaccagcccccggccgcctgccaggcgtatggaggcatccgggatcagaaaacggaatacggccgccgtccggcataattcttcgttggtgagaaccggattatgttcataaggagttccgggaatcggattcagcagatttaccggaatcgatttaacgcccagtcccctggcagtcaggaccatatcgatacgatcctccatagtctctcccaggccaatgatgccgccggaacagacgtcaagcccggctcttacggcggcctttaaggtctcaatcttatcgcggtaggtgtgcgtggtgcagacctgggggaaatagcgctcagacgtctccagattacagtgaacccgtgatgccccggcacgtttcagtttctcaaactgcctttctgataagagtccgaaagaaacgcataccaaaattccgacctgcgctcttatttcgcgtatgctttcacaaactgcatccacttcccggtcagaaagtctttttccggaggtcacaatggaataacgaaggacgccctgttccgcgttatattttgcctgttccacaagcttttccgttgacaggagctcatatgccccggtgcaggcggtgtggtaatggacactctgggcgcagtacttacagtcctccgaacatctgccgcattttccattgataattgtgcacaggtcaaatgtgcggccgcaaaagcgggtacggatttcatccgctgcttcggtcagctcctttaacggcgcctctgccagacgcagcgcttctgcccgattaatctgttctcctgccaatacccgttcctttaattcttcaatcatattcccattcccctcattttcctcataacaggctgaatgcgctttacaagatacgcggccagaacgcacaaacagagatcacccggaactgccagaataaagcagtacaaaaacagaggccacagtccgatcggcgtattgatgatgaaattgcagataatatagtaataaatcatccccacgccgtaaacgatgaacaggccggtgaaatttgcggtcagcagctttttaatcgtcagtggatactgcttttcaaccatttttccagttacatagcttgccagacagaaaccgatgatataaccgaagctgggttttaaaaggtaccagagcccgcctccttccgcaaaaatcggaagcccggccaagcctaatatcatatagagggctacactgagcgctccgccctttccgcctaacagcagccccgccagcatggtaaataaaaactgaagcgtaaacggcaccacgggcaccggaattttgataaacgctccggcggcaatcagcgttgtaaacatggcggtgtatgtaaggtttatcgccgaggtgtattgtagtttcttttctgctctttctgccatagttcctcctgttacttttttgattgtaaaccataataaatactaagtttacaattgtaataagataaatattaccaataaatagtgcaaatgtcaacttatataattatcaagttcacatttatattattattgagcttactattgtgccatcagcaaaaagcaaaggttcacaggaataatatttctcttcctgccaatataaccgtatttaaaaaaataatttaaagaaagaatctcagaaaactccacgcaaaattcaaagagccatgatatactggcttacaggaggagtaacctatgaaacgaattttagttattgaagatgaacccgatattcaggaaatgctttgtgcatatctgcgtgacgccggttacagcgtgtctgcggccagtgacggaatccaggcgatggactgtttccaccgggaaagctgggatttgatcctgctggacttaatgcttcccaagatcgacggctacggcgtatgcgagttcatccgcagggaatctgatgtgccggtcatcatggtgacggctctggatacagaggaaaaccagatccgcggatttgatctgcagatcgatgactacgtgacaaaaccattttccatgcccatacttttgagaaaaattgccgcggtcctgcgccggaccggatctgaaacagaaagtcgtcagctcttctaccgcgacatcgtcatggacttagacgcgtaccgggtaaccgtagatggagcattgctcgatctgaccactcgggaatttgaacttttaaaagagcttttacagaatcaggggcgcgtcctgacccgttctgtgctgttgggacaactatggaattacgactttatcggtgatgagcgcatagtggacagccatatcaaaaatctgcgaaagaagctgaaccgtgactatattgaaacggtaaggggggtgggataccgtgttgaaaagattcattgatatccggacaagtctgactgcgcgtattttcttaatgacgatcgtgattctgctcatatccagcagtgtaacctatctctttctcgcatgggcgacgccgatatcctatcgctccatcattgccgataatttaaacgaaaaggtggaccggctgatcagtgatttggcggaaacgacctttgaggaaagcggtccgctgatctcccgttttgagaaggagaacaacgcggagattcggattacggccggagacggagaaacgtcccttctgcccggcaatgcaccggaggaggaggctgtggattcagtcatcatagaagacgatggctcttccgtatccacatgccgttccactgctaccgcagtcgtttccgattcctcggaagtcgaatatacgagtacagactgggatgcggccgtaacgttcaagggaagcggcaagccgtatgatttaagcgtcgttatccgcgtttccgctgtcaatgagacctccgaggccatgcggcgcgtgctgccctgtcttattctgatcatgtttgtcatctccctgcttggggctcttttttactcccgctgcatcacccggcccattgtcaggctaagcggtatctcccgaaagctggcgtccctcgatttcgactggaaatgtccggagacacgaaaagatgaaatcggtatgcttggcagaaatttaaacgaactctccgaccatctcagagacgcattgtcggagctccgggacgcgaacgcttctcttcagcaggatatcgaacgcgaacgcgagatggaacgccgccggtccgccttttttgccgccgcttcccatgaactgaaaacaccgattaccgtcctgaaaggacagctttccggtatgctggccggggtggacatctatcaggaccgggataaatatctggcccggtctctcgctgtaaccggccgcatggagaagctgattcaggaaatgctgacgattttccgtatggaacaggacgactccgctgtccgcagcgatacggtcagcttgacggaactgattcaggaacagctcgacctggccgaagatttcgcccagttgaaagaacaacagatatccgtctctttaccaccaaaagccgtgatccagggagaccgggtcctgttaagctgcgccatatccaacctgctgaccaatgccttgaaatattcaccggatgcggctcttatttcagtcactctctccgaaagggacacggggcttattctggacatagagaacagcggagtccacatcccaccggaatcactcccccgcctctttgaacccttttaccgggtagaggcatcccgcagccgtgagaccggaggcagcggtctcgggctctatcttgccaggatgattctggaccgtcatgaagccgcgtgcacggtcatgaataccgggatcggagtccgggtaacggtgaatttcagttgtcagaaagacgacagtctccatgaaaactacacataaaatccatctcacctccaaatggatcatttataatcaatgggaatacacgcaggaggaaaaacaatatgcggataaatattgaacacataaatatgatctatccaacaggaaagcaggcgcttcacgatatcagtctgacgatggagagtccaagcctcatcggccttctcggccccaacggcgccggaaaatcaacgctgatgaagctgctggtcgcagggcttctgccgtcctcgggaagtataaccgttgacggcgagcccctggtgaaatgtgaaagagctttcaaggcaaaactcggctgcctgccccagcatttcggactttacgacgagcttacggtctggcagtttctggactatatggctgctctcaagggctgctctgacagcagagccgctattgacgaggcgctcgctgccaccggcttaatggagctgcgcaaaacccgtatacggactctgtccggcggacagcgccagcgggtaggaatcgcacaggctctgttgggaatgcctgaattcctgatattcgatgagcctaccgtaggtctggatcccgaggaacgtattcgctttcggaacttattttcggaaacggcacagaacaggctggtgctgctgtccactcatatcatcgacgatgtacagtctgtgtgcaaccgcctcatcatcatcaaccatggccggatccttttcacaggtactccggaggagctgatccgccaggcttccgggcatgtgggcgtgtttcttgaagatgccagtatacgcagagattctggccttcacatcacctcccggatcaatacggcaaagggtgtgctctgccgcggcgtggcaaagactcttccaccggaggccgaggcggcagaacccacactggaggacgcttatctctacctcatcacgaaggaggggcaataatatgaatgcatcctcactctttcgtgtggaattcggccgtctcatgcggaatcgtctggcctggctggccgccgcactgaccgcgctggcccccattgccggctattccttttatcatcctaccatcggagattctatgggcgcgctctatctggcgaatccgatgctgaccggcggaatggcagggacgcttctcttcgccctgctgatccttgcggccctggatcagcccgcccgcagcggcactgcagcccttatagagacgattatccctccagtgaagatgcacgccatacggctgctggctgtgttgagtctggctgtcctgacgtccctggctgtcggaattctctaccttccgtacaccatgtggaaattaaatatcgtgttctccttctcggattactggctggccgttctcttatttctgctgtcaggtcctgtcatggggactctggctgccgccatggcgatccagataaccggacggctggatgtgagcgttcttgcactgctggccgctgtgatcttttcgcgcagccgctggtgcagccagtactttctcgctcactggaatattcctctggtttccaccctgtccgacgccttcgggagcgctgtcgtatggcgcaccgcgttctacagccgtctggtctggctgtgcctgctgggcggcggctggcttctctctcttctgtgcgtccggcagtacggaaaaggggcggccggttccctgattcacagaatcaaaagaccggtactccctattttctccatactgcttctgcttctgggtgctgttttatggaacaggcagccctttatagaccactgtcccgaggactggatttccatggagacagccgatcgttttcatgaacatctgaccacagagagtacatccctgaacgtgaccatcgacagcttcctgatggggactctatcgggggaggcctcctggcagattcgcaacaattccggcagtccacaggagctttacttcaatttaaacagtggctatcgtgtccgttccatcactgcaaatggggagccgcttcctttcgaggatctgaaaaatgactatatcgcttccagagagctgcggtgtacgctgcctgcggatgaggaaatcagccttgtgattacatacggaggcatgccccgcatctggaatgcgcaggaacgggagctgtccggaaactacatcagcagcagaggcatttatcttgcaagccaccatctcgctcccacggtagcaggctgcgcccccgtggaggatgaagatacgcctgtcaccttaaccatcacgctgccggctgccatgactcccgtctctaccggttctccaaagcagctttccgataaccgtgacgggaccgtcagctgggttattaccgatcagggaaccgatcggatacagctgtttgccggagactatatctataaagagctggccacaggcagcggtatgcctatccagttttactacagcaaaaaataccagtcacgcctggaaaacggagccctggagctgatggaacaggccatcgcctactgcaccagccactatggtccccgttcctttaccgaagacaaaccgtttaagatcgtccagctgactgcatttcaattcggcggttttgctaaccgcagcatcagcggcatgggtgaaacgtacttcagcgacgagaatctcaacaatccggacaaaggaccggccagcgccgaggtcctggcccatgaaatcatccaccagtggtggggcttaggcgcaacgctgtacgatccggaggacgaggactggaatgacgagggaatcaccgtctataccacctaccgtcttatgagtgaaattatgggcgaagactatgcccgggagaactatacagacaaatggaaggctgtcatggaggatcagcacgcatccttttatcagcgccatccggaatacttagaccgccttcccaaacgctactcaaatgagattctggcctccagaagcagcgccaactggtatgacggcaacgccctgatgatctaccgtgccgccgagaaggcaggtccgcagaaaattgatgaaatctggtccgaactctacaccagacaggcctccggatcgtccgatatgatcacactgacggattttttagatgcctgtggcttaaagaaaggggaggtggaacgtgaataagatattccgatatgagctgcgccgtatggtgttcagcaaattttaccttggcttaggcgccgtaaccatctggtatggatggcagatattaaataccacaacgattctgggcacagcccataccgcgcccttttccccctggagttttggcagctatctgtcgcagcttctgcccctgctctgcgtggccctgctgttccttgtgtggaaccagtgcagcaatacggcccgccgcacagctgtgctgaccaccacggccgcgcagaatccgggtgtctaccggctcgtaaaatgcggcgctgcggccgctgcctggcttttgctggtgcttcttctggccgccctgggaattggattcctgctggccttattcggcagggacgtccctgtcggtgagtacgtggtgccagcgctggcggcggtcctgcctccgatgatccttctgctgggaaccggtctgctggcgggacaaattcacacctccctgctttttccaatgatggctctggtattcggaacaggctttctcccgcttcccgacagcctcgatctctacagcggcgctcttttctcgcagtacccgctgacactggaatacctggatcccgcgttttccatgccgctctcgtccgtagcaggaaaatgtgccatagttctcattggcgctgcggcatttatttagacgcaaaggccggaactgtttcatattcataaacggaatgttccatggtcggcttgaaacggtgataaaatttatcaatattatctaaagtccacagggcataacgcctcgccctctatttcaacaatatcatcgaggggaattaccgttccctccagcataatcagcacgtccctgtaacgatccactttcctgacacggccatggacagtgacgtaggaaccgccggcttttcgctcgtctgcaacgaaaaagatgaccgttacggctggctgttcctttattttttctatcaacagcagcagtttatcattcaggatctccttgctgttatcatcaagttcaatcttctggtcagtcagccgcgccgtttcctgaatagccgcatcatggccggtcagggccgcaaacggagaaaactgcgccgcgcggtcagataccgccatgctgggatgtatagtggaaacatgatggggcaaatgaatgatgtcgtcatagcgatctggtcgatccgtctctctctgcatggatgcctcctgtaaaattacgccttatgaccgccgatctggtggttgcgttcgattgtcatagccccctcctcgaggttcataccttttaagaggacatttttcccgaatttcttcttaatatccaggacagccttctgaagctgtctttcccgttccagctcctgctcttcccgctccctctgcttttgaagagcctcgtaatcggtaaacaggtccatctgttcaaagctctcctgccttgaaatactgccttcctccaccacatgattcacggtaatgtaaatcctgcggaccagcagatcctgatcgacgatcctgtcgtacagatccatggcggcgtccatgatcagttttgtggaagaagtctgccgttttagattcaccgttccatgtgcgtgtttcggaaccctgcggccgtagtggtctgtggtgacggctcccttatactttttactgatctcaggcctcgtcagattctcaatatcgtagcccacagtcagcaccaactgatctgttacaaggcccttatccaccaaatccagcaccagcagatctgtcatctcctggacgatcagtctcgccttcgcatagtcgtagggacactgcagcacctggccggcaccggtgctgttcgtctccggtttataagccttcacgtctgccatcgtacagggctcccagccccacgcatggtctatgagaagctctgcgttgatgccgaacagcctgtagagcagctcctcattatggtaatccgtcggcttccccagggagcatctggcgatgtcccccatggtatacaaaccggcggcctccagcttctttgcatacccacgccctacccgccaaaaatccataagcggtctgtgtgtccataatatgcggcggtaggaatcctcatccagttccgcgattctgaccccattctcatccggcgcgatgtgtttggcgacgatgtccatggcgactttccctaagtacaggttcgtccctatgcctgccgtggccgtaataccggtcttctttaacacatccatgaccatccttctgacaagctcccgggccgtaagcctgtaggtacgcagatagtcggtcacatccacgaacacttcatcgatggaatacacgtggatatcttccggtgcaatgtagcgtagataaatattataaatccttgtactgtattccatatacagcgccatacggggcggcgccgcgatatagtcgatggaaagggccggattcgcctttaaatcccggtcattcacagaggtcccggaaaaacggaatccaggagccctttgcctccgtcccgcgttcgcctctttcaccttctgaatcacctcaaacaatctggcacgccccggaatgccataggacttgagcgccggggaaaccgcgagacagatcgtcttgctggtccggcttgtatctgccacgacaaggttggtagccaacggatcaagcccgcgttcgatgcattccacagaggcgtaaaacgactttaagtcgatggccgcatagattcgattttcatattttttcatagctggctgcctccaaaacaaacatatgttcttgctaaggatagaataccacaattgcagagaaatatccagtgaaatgatggttggaaaaaaagtactgatgaaaacgaactgggaaaattcccctgcgtatgtcgtcaacaatcacattgcaccaaccgcagttacgtcacgccatccacaaacaaaaacccccggagaaaatcctccggaggtcttcattgtacttcatgttcatgtcatagagattgttgaaaattagtcttcaacgctgatgatttctttcttgttataagaaccgcaagccttgcaaactctgtgaggcatcataagttcgccgcacttgctgcacttaactaagttcggagcactcatcttccagtttgctctacgtttgtctcttctagctttagaagatttgttctttggacagatagacatggttacacctccttaaactgtttaaaaatatcctggatgaccgccattctggggtccaaagaccttgtatcgcagtcgcaagtctcatggttgagatttgttccacatctattacaaatccccttacagtcttcactgcagagaaccttcataggcagattcagtatgagttcatcacaaaccaactggtccacatccagattataaccacttaaatatggttgttcatcgagatcttctacacgctcttcctcggattcattcaaatccagagtgcggataatatcaaattccaacggtacttccacaggatcgaggcagcggtcacacggaactttcagagtaagctttgccttcccctcaacttccagcttccggtcacccagattcataattcgcagaaccaccttatccttggaggccacctcataatcgccgttagggcaatgataggtgtccatttcaatatcgggtgtataagttttctctttcccttccagggtaaacaactctgacaaattaataagcatattaatctccattaatacgcacctatgctattatacacaggcgcgcatcatttgtcaataaaatatttccaatattaaacaaccagttatttcacaagggctaatgtttctctggcgatggacagctcctcgttagtcgggatcacacatacttttaccttggattccggagtggagatggtcactctcttgcctcttgccttgttgatctcaggatcgatctcgatgccgagatatcctaaatattcgcacacagcgcctctgatcggcttatcgttttcaccgacaccagcggtaaatacgatggcgtcaacgccgttcatcgcagctacatatgcgccgatgtatttagcaacacggtagatgaatgcctggatcgcaacgtctgccttatggtttccttcgttctgtgccttctgaacatctctgaaatcgctggatacgccgccggacattccgagaataccggatttcttattcaggatattgaggacttcattgacatccttgccctctttgttgcagataaactgaacaacagccggatcgatatcaccgcttctggtacccatgatcaggccctctaacggagttaatcccatgctggtatcaacgcacttgccgccgatggaggcagatacgctggcgccgtttcctaaatggcagacaataacttttgctgtctcagggtctaattcacagtacttgatcgcttctttggatacgtagctgtggcttgtcccgtggaagccataacggcgaatgctgtacttctcataatattcgtaaggaattgcatataagcttgccttctccggcatcttcataccaaatgcagtatcgaatacggctacgttcggtgttcccggcatcgcttcctcacacgcttcaattcccattaagtttgcaggattgtgaagaggtcctaaatcgaagcagtcgcggattactttctttacatcctcattaacaacgatggagtcgctgtagacagtccctgcgtgcagtacgcggtgtccgactgcagagatttcgctggtatccttgatcacgccgtattccggatctaccagagcgtccatgaccatcttgatcgctaccgtgtgattcggcatctcttttttaacttccagctcttccttgcctgctgccttgtgggataaattggagccttcgataccgattctttcacacaatccttttgctaaaacctcttcgttctccatatcgattaactgatattttaaggaagaacttccacagttgataactaaaatcttcattttacagtatttctccttttattattttacgatttcgccgtactgttctctgccacaggcagcggcattggattcatccgtgtcaatatgcatagccagcgcatagctgtcacttacacgaactactacgtcgccgaatacaaggcttctgccgtctgtatcaaccttaacggatacaatatcgccgttcttaacgcccagtgcctcggcatctgcgttggttgcatgaatatgacgctttgcagcgattacgccctctgcgatctcaatctctccgcatggtccgacgatcttacatgctccgcttccagcgatgtctccggattccttaatcggcgcagctacgccaatggcacgggcatccgttaaagaaagctctacctgagttgcctttctgaccggtcctaagatggatacgccggctaattcttttttggaacctacaatggtaactctctcttcgcatgcatactgtcctggctgggataaatctttctttcttgtgagttcatatcccttaccaaataaaatctcaagatgttcctgagttaaatgtacatgacgcgctgacgtttctaccaagaatttcatacctatattctctcctgttctttttaataatatgaatgaatattacaattctgcttctattctatgtgctttgattaaaattttcaagtgctgtctcgaaataatttgcattttttatgaaacaattgcataatagagtggaaaacagcaaaaaaaggacgtaatttatgacgaaaaatgaaaatgcttacatcgtcggcattatagcggaatacaatccgctccacaagggacatgcctggcacatacaaaaagccaaagaactggccggcgctaaatactgtatcgccgtcatgagcggtgactttgttcagaggggcgccccggcgattttcgacaaatacacaagaacagccatggccctggaagccggcgccgatctggtactggagatgccgtccatcttcgctgccagcagtgcagaagatttcgcggcctgcgggatcgcgctcctggaccgcctgggcgttgtcggttccgtctgttttggaagcgaatgcggcaatatggaagaaatttcccgtgctgcttctattttagcctcagaaccggacctttatacggcggcactgaaggaacagctaaaaaaaggcttcacctggccccaggcgcgggcgcatgcactctctttaaccggcgacttcgataaagagctcctggattctcccaacaacatcttgggaatcgaatatgcaaaggctctcataagacgaaaaagcccgatccggcccatcacggttctgcgtcagggaagcggatatcacgacaccggattttccgatgtcttctgctccgcctccgcaattcgaaaagagctggaagcaaacgcatcaaacggcggcgagggacttcccgcatccgttctccagggcatgccatcatttgtcggagacttcctggaaccggcttatccggtctttttaaatgacttctcgacgctgcttaatacggcgctgctgcgcatgacggcggcatcggatccctttgagcagtatctcgatgtctcggacgacctggcggccagaatcaggaaggagcttctctccttctcttcttttgaagaccggataggcgcgctgaagacccggcagtacacctataccagaatcagccgcgccctgctccaccttctgctcggcatcacggatcaggagattatggccggccgcgccgcagattacgcgccttacgcccgtgtcctcggctttaaccgcggtgcttccgcggtcctttcagacatcaaaaaaagagggaccatccctctcatcacgaaaacggccgacgccggcgatcttctggaaggaacggcgtgggagatgtttcagaaggatctgttctgttctcacctctaccaggccgtcgtttccggaaaatatcatactcgtttgaaaaatgaatatacgcattcggtcgtcatgaagtcatgacggccggatgaaattctctatcttatctttatagagcagaaacctggatttcggaaccacgattccctgacgccacatctccatcagctcatcaaacacgacaaacttcgcatctaccacttcctccgcctgaagctttaaatcctccagatttacattctggcgggtaatgtacgtatccacaaaccgctcctttaaacagatggagtggatcagatgaagctcgtcttttgacgcgtggattccgacttcctctgagagctcacggagcgccccttccacgctgttctcacctgtcagcacagatcctccggtacactcccacaaaaggccgtacggcttatccgggtgccttctggtgagcagtatctccgatctctggttcacggtccagacatcggctataatatggtactccccaggtcccagcggcacgccccgctcatgtgtcttaccggtcagtttcctgttctcgtcgtaaacatcccacaattccataggtttttcctcctagaaattggcgccgttccagccccagtgttccacttcctcgtatttgatgtaaatcttatcctgaggaatccccagcacctcctcatagatctgacacagtctggccgtaagcttatcgtaagcttcatccgtagttccgccgaaaatcttcacctccacataagccagtttcgtatcattcttccccttgaaataaagagaataattgtcctcaaagccaaccatcagccagctttctgatttccccggaatcagggatattgcctgtcccagcttacccttcagcgtttccttctcgctgtccgtaagcggcacacttaccttggaattaataaatggcataattttactccttcctataattttctctatcataccacagtcaaagagaaaatgccattctgatttccgtaattccagcccggttttattcttccagcagcagcccggccagcgtctgttccgtccccaaaaactgcaggatatcctcgatctctttccggttgtccttcggcccgccctgtttcaccgcgcggatcagaatattcttcggagtgtgttccatatcgataaattccaggatctgagtccgatagcccctgttttccaggatctccgcccggagggcatcggtgtataaggctgccatacgctccttgatcagcccgtactggagcaccgggcgcagcagctcgttgtccatctgtttattcagctcatgctgacagcaggggacggagagaatcacggaggcatcccattttaccgccttttccagggcgtaatccgtagccgtgtcgcaggcgtgaagcgtcacaaccatgtccacatggtccacgccgtcgtaggaagcaatatcgccgtgataaaacttcagcttgtcgaagccataggccacgcttaggcggttgcagtggtcgatcacgtcctgctttaagtccagtccgataatgcgcacctcatagcccttcagctcatggagataataatacatggcaaatgtcaggtatgattttccgcatccaaaatcgatgattacattttccctgctcttgtccagtcttgggagaatgtcctcaataaattccagaaaacggttgatctggcggaacttatcgtagcgggaacggacgaccttaccatcggccgtcatgacacctaagtcctccagaaatgcaacaggctttccttcctccaggatatagcgcttctgccggttgtgggaggccacgttcggagctgccaccattttctgctgatttttcttaactttaatcgtgacagtccctttcttgccaaccaacacacgggcctgtcccctggacgattccacctctgcctgcttaaaaccgctctccatcagtcccagcaagtaggatacgccttcttctctcgtcagatttcggtgaaatgcctgtttctccgtcagttcttccgcctggaaaaccatgccgcctttcagcataaccgggcgtacccggaccttcagtgctttgcacgggcctgcaccgtccttaaaggccggattgctcaggattatcctgagcaggctgtcgtctaaaaagtcctcaaagatcttcttaacctcttctcttttttccagaaccatactgctctgctccataaaatattcccctgtcctcttaattctccgccgatacccagctgcttcttaagagctccggatgcggctccaaatgcgcgtaatcattaaaacgttccacggtaaagcgcgcattgcccgggttataggccacctcggtaatgctgcagttttccagtgaattcccgagaagccggtatctggccggttccatgcctaataatgcggaggtcatgcttcggattacaccgccgtgagtgactaccgcaaccgtctgataaccgctctcagcaatctcacgaaataccggcatcacccgccggatcacgtctcccgcacactctccgcccggatacggcaagtcggcttccatcttttcctgttccttcttaaatgcggcaaatttaaccgcaatatcctcgtcgcacattccttccatctcaccgaaggagatctcgcgcagctcctcctttacaatgtgttccacattccagaagcggtttgccgtctccgcagtctgaaacgcccgcagcaaatggctggagtatacagcttcaatcttctctcctgccagacgttctcccaaaagctccgcctgtcggaagccctctaaagccaaatccacattgacgttgcacagctggctgcactggcggccatgacgaatcagatacagtctcatccgatcttcctcccaatttctcttttctgttaaatacggcccagatgggtgttcattcatctgggcctttctttatttaatcctaatttttaaagctgtggattggagccggaattctgcctccgcgggtcacgaacttctcacaggaatagggattgaccggcataaccggggcgtagccaagcagtccgccaaattccaccgtatccccaatggtctttccgatcaccggtataagtctgacagcggtcgtcttctggttgatcataccgatagccgcctcatccgcaataatgccagctatggtcgtcgaaggtgtgtcgcctgggatcgcgatcatatcgaggcctacggagcagacgcacgtcatcgcttccagcttttcgatcgtcaaagctcccatggaaaccgcatcgatcatcccctggtcctcgctgaccgggataaatgcgccgcttaagccgcctacataggaggaagccatgacgccgcccttcttcacctgatcgtttaacatggcgagagccgctgtcgttcccggagcgcctacacgctccagaccgatctcttccagaatctcagcgacactgtcgccgacagccggagtcggagcaagggacagatcgatgatgccgaacgggatatttaagcgtctggaggcctcctgagccaccagctgtccgactctcgtgatcttaaacgccgtcttcttgatagtctcgcagaggacctcaaaatcctttcctctcgccgtctcgatggcggtctttacaacacccggtccgctgacgcccacattgatgatggactcggcctccgtcacgccgtggaacgcgcccgccataaacggattgtcatcaggtgcattacagaagacgaccagtttggcgcagcccagagaatcagactccttcgttgcttccgccgtcgccagcacgatctcgcccatcagcttcacggcatccatgttgatgcccgtctttgtggaacccacgttgacagagctgcacacacgctccgtaacggcaagcgcctgcggaatggaacggatcagcctttcgtccgcgtcggtcatacccttgctcaccagagcggaataaccgccgataaagtttacgccaacctcgtgagccgcccggtcgagggtctttgcaatggtcacatagtcctccggactcttgcaggccgccgcgccaaccatggcgatcggggtaacggaaattctcttatttacgatcggtatgccgaaatcgcgctcaatctctctgccgactgcgacgagatttttagctgtagtggtgatcttgttatagatcttctcattgaccgcatctaaatcgctgtcgctgcagtccagaaggctgatgcccagggtaatcgttctgacatccagcttctcctgttctatcattttatttgtttcatttacttcaaacatattcaacatatcgggggcccatcctttttcttatgcttattctttcattccgaagtgcagtactggcaaaatgctccgtaagtttcttcgaaaacgcagagtggtacagcattcgctgctgtcagatacggtgcatcttggtaaaaatatcctcgcgctggcattttaccttaacaccgatctcgtctccgatctgttccagttcatcggcaagctctccaaaaggttttgtggcgtcgttcgtgtcgacaatcatcatcatattaaagaaatcctgtacgatggtctgtgagatatccaggatattcacccggttgttcgccaagtatgtgcaaatctttgcaatgatccctacggtgtcttttccaactactgtgataatggttttcttcatgctgctttttctcctcttttatatagtgataatttccgacatcctgtctcttcccgcaaccgcgatcgaaaaatcggacgccttaaatggattatctccgtctgtaatctccagctttacggtctcgtaagccagctcctcataattattttccttgctcaaatggccaagcagaatccgttttaaattatcgtgcagaatgcagcacagaaggcgtccggcgttctcattggagagatggccgtgatcccctaaaatacggcgcttcaggtagtaaggatacggtcctgcctgcagcatgttgacatcgtggttggattccagcaaaagcgcatcgagtccctgcaaatgatcgattatgtactggtcatagtgccccatgtccgtcgccaccgccaccgatttatggtcatgctggatccggtatgccaccggatttgccgcgtcgtgatcgatcgagaaaggctttacctccagatcaccgacgaagaagtccacatccggacagatgggatggtacagctctctgggatactctcccagatacttctgctttgatacctcctccagcgtttcctttgttccatagagaggaacaccgtattttcttgccaggactcccagtccctttgtatgatcagaatgctcgtgcgtgatgacgattccgtcgagctcgctgccttttaaaccaatttcatttaagccctgctcaatcctcttattgctgatgccggcatccaccagaatatgggagttgtccgaaccaacatagatgcagtttccgctgcttccgctcgctatacttaccagtctcatgtttcccgtcctttatctttcaatagggcctccagcccggcttttacctcttccacggtcccgttgttatcaatcacccggtccgccagttcccggaattcctcatccgacagctgattcttcataatgcttagggaacgctctctgctgtatcccctgttttctttcaggcgcctgatacgattctcttccgatgtataaacataccacatttcatcgtagatgtcatcctgttccctgcccataattgcagattctaccacaattaagtccgcttgtgaagaacaaattttatctttgatcgttttccataccatcggatggatgattccgttcatcgtctcaagcgcattttggtcatgaaaaatgagtgcggaaagcagcggacggtcaatggtgccatccggttttaagaagctgttccccagggcgcggacgaccatctcgtagccctcgtgccccggttccatcagctcatgcgccacctgatcggcgacaataatttctgctccgtactctgtctgcaggatatcgagaatccggctcttcccggcgccgactccgcctgtcagtcctatcactctcactttttctccctctctcctgtaaggcaaatatccggcgaattcgtcctatttggcgtcaaaccaggaatctccgacgttcgcttccacctcaagagaaactgataaatccgctgcatgcttcatctcgtccaccaaaagcgcctttaccgcttccacttcatccttctgcgtctcgatcagaagctcatcgtgaacctgtaaaacaatgcgcgatttaaggcctttcgcctttaatgcacgatccacacgtatcattgcgatcttcatgatatcggccgccgttccctgaatcggggagttcatggccacacgctccccaaaggagcgctgcataaaattagtagatttcaattccggcaccggacgtcttctgccaaacatgctgaccgcatagccggtctctttggcgtccgccacaagcctgtccaggaattccttaacgcccggatacgtctcaaaatacttattgatatactccgtcgcctctttcctggatatgcttaagccctcgctcagtccaaaggagctgataccgtacacgattccgaagtttaccgccttggcatttcttctctgcagcggcgtcacctcgttcagaggcgtatggaagacctcggaagccgtgatggcatgaatgtcatccgcatggcggtaggctccgatcagcctctcatctccggacatatgcgccaggacacgaagctcgatctgggaatagtcggcgtcgatgaagacacagccatcctccggcacgaatatcttccgaatttcacgtcccagctccatacgaaccgggatgttctgaaggttcggctccgtactgctgattcttcccgtagccgtgatggtctggttaaaagtcccgtgaattctctcatccgtcccgatatagacggccagaccttccgcataggtggaattcagcttggtgagctgacggtagtcgagaatcatctgtaccaccggataatcgggagccagtttgtccagcacatcggctgccgtggaataaccggatttcgtctttttcccattgggcagcttcatatggtcaaacagaacctcgcccagctgcttgggagaattgatattaaaggtttcccctgtttcttcataaatcttctgctccagcgcgacaatctgcacctttaagcggtctccgtactccttcagccgctctctctccgccttgattcccacctgctccatgtggaaaaggctgtagatcagcggcatctcaatatcggtaaagaggctgtacatctcggccttcttaagctcctcggtcagacggtccgcactcataaaggcgatatagcccatgtagcagatgcacgtaaacgccttcttctcatcgctctcaagcgcctttttaatcgtctgttttcctaataaatcggctctggacgggacggtcatgcccagataatcacgggcaagatcatcgtaatcatacgtatccttaagcggatttaagaggtaaccagccacactggcgtcaaacagcgggctgtctgattcggctttcaaaaatggaagcagcggctttagcttaagcacagatacccgttcgcatgatctgcacaaatcccttgccttttccaccagatattccgcccgcataaagccctgggggacgaaacagtaggtggcttcctctcctgtgcagagcgccatggcagtcagctcatggtcctcgatcacaagttccaggccaatcttcgccccggctttgcaggcggcaaagatggcttccgcttctccaaaatcggtgaccatctgaaaatgcgcctccgccgacggactctctaccggcgtatccgagaaacgggaaaggagtgatttaaactccagacgcttcatatactggtaagcggccggtgtatataagttgtccgctttggcatcgtcataggaaaattctattccgcagtttatattgatcgttgccagctccttgctcagctgtgcgagactgtaattctcttccagtgacttcttcgctcttggcggtttgatctcctctatatgggcgtaagcgttctcaatacttccgtatgcctctataatggcagcggccgtcttctctccgatggacggtactcctggaatgttgtcggaggaatctcccatcagggccttcatatcgataaattccgttggagtcacatggtactcattcttcacatcctccggatagtagtctttaatctccgtaccgcccctgctggtctttggaatccggatcttgatatgctcgtcggccagctggagcagatcgcggtcacctgataccacgaccacctccacgcccttcgcctggctttctttcgccacagttcccagaatatcatcggcctcgtagcctgccatcgtaaggatgggcacctccatggcgccgaggacttctttcatcaaatccacctgctcgtgaagctcctccggcatgggttttcgcgttcccttatacggttcgaacatcttatggcggaatgtgggttcctttcggtcaaaggccaccgccacatggtctgcctgctcttcttccagaatcttaaacataatgtttaaaaatccatatacggcgttggtatggagtccctctgaatttgtcagctcaggaattccgtagaatgctctgctcatgatgctgtgtccgtctattaatactaatttctctttgtccatgttctctcctgtcagatgagtcctgactgcagccagatgcggcactgcagaaggaccgtaataattaatgccataacgctgagtgtggataccgcatagcgcacgatcttaacgagccgaacggcttccagtctttccctggactgttcgattgctgtctcaagcgctcccttgatgttataattgcccgtctcggagtccaactgccggattcccacgtcaacagtaaaatatatctccagctcttccctgcattccgggcaatgttcaatatgctccagaaattcaaagagttcttcatcagtcagttcgttcttaatataaggcattacaaggctttccgcttctttacatgtcacctccggacacctccttccacaaatctctatctatcatacaatatatttccaccattttcaatttaataatcataaaaaacacttgccaaatggaaaatcctgtgataaaataatcaacgctgtgattgttacgccggcttgtcggaatggcagacgaggtggactcaaaatccattggtggcaacaccgtgcgggttcaagtcccgcagccggcactacacccttggcagggaattggactaaaaataacgtatctgcgttatttttggtccttttttctattaaaaaaggggacccgccgaatgcagcagattcccttttacttgaaacgcgataccgttctataataccgttctataattctttccggacgcttaaccccagcggcttggccacacggtcctttatactctccactttccccagcatcagccattgctttgtgcattctgcgcttgctctttcgccgtcatccggccacatggaacgccactttgcaaaacatttattctccagcttgctgaaaaccatatagatcatctgtaattcttcttcggtaaactctaaattataaatttgcttttttatcactgtatgtactccccctccattgtcaattatcttatcccgaccggctcctggtataaaaagtatacagcttttcttaaattcggtcaactatatgaatatttaatccaccatataaacataccatatgtagtaaactactgaaaaaaggagaattgatatggttgactttggaaacaccttaaaaacattacgattacatgaagaaatgacacaagcccaattatcccagaaattagggctgacaaaatccgtaatcagtgcctacgaaaccggcctgcgcctgccgtcttacgatgttttaattcacattgcacagatttttaaagtatccacggattacctcttaggcgtagagcagaaggacagtctggatctgtccgggctgacgcagaatgaaaagtccgcactgttggcactgatcaaggctatgaaaagcagataagactccaaatgatacgcagactctactatgggctgctgttaataaccaggctgcatgtcccgcagagaaacgtcgcagcctgtctgactgccgtaataaggttcattggaatgcgctgcgatgcattcctccagatgatctgagtttaaagaaaaaccaattccttcatctctgtaatcggtatggtcccccctcatcttcatacatttatattcaaaaagcgacagttctctgtatatgaaaccgtattgaagatatgcgatctcccgatcctgataattgatgcttttactcgtcgatatgggaccgtcgtccaaatcccgatatgtaactgcccggtttccgatgatcttatactcaccgtaatacgtctcctcctcagtttgatttgtcgaaaaagccggcaatggaaaacagaagcccggccactcccacgattagaatcagccagtccattccggacgaacagagcgccagcacaattgcaaataatagtattgcgatacctaatgtgatttttttcatagttttctgctcatacacctcctcatcctcaagcctcccctgtttcatacggtatttcggctatatgcagaatgccgtctgttgaattttccttcctgttattcttctctgcttcgtgttccacttaatctccctccttattttctctcagacgttttcactttcttcgcccttttctttttttagctctctcaatacctcatccagttttttcataatcatacaggtgcagacaatcactatggccgcaagagccgcaaacccactgtaaaccggatcgacataagactttataaatgcatcgcctcccggcacaagcacagagcttattcctgccaaaataataaaattaaaataataaaacaccaggaacgttacaattcctattactgtttctttcatatagaattctcctttttctcaataatcctgcttttttatggaatcggcgcattccacatttaccggatggggaacctgttctgaggtgacatcaagatacgatatcagcgccagtctcttctcaccatctttacccagctcattataacacggcaagcccctttccgcatacacttcataagaaactaattacatcgaaacaaaatcttaagcaattctgcaatacatttccccaccattatggtatactattcctatcgaattcaaatgataaaggaggctttttatgaagcgatatacggttattctcaccctttcactcgtctgtgccctttcacttgcaggatgcggtaagaagaatcaggacaaaacagatttgacaagcacccacaccacggcggcggagaccatgtctcccaccacgacagcggcagagacgaaagagacgacagccgcggacaaagagaccacagatgcggctggcggcgaaacgaaaaaagatgactcgaagaaggcagacagcgcttccagcgtcaccacatccatacacacctacaccaccggacacatttccgtcgaatacccggttgtctctaatttgagcaaggctgccgtacaggaaaagatcaacaagctgctaaacgagcatgcgctggaattcatcaaggcctatggcgtgaatgaaagcaaggattccctcaccgtgaaatgcagggttgtctctgcggaccgcagacgcctgaccgctgtttatacaggttcctacatgccggagggcggcgcgcatccggtcagtctcttctatacgaataccattgacaccgcactcggcgaagacatgggtctcacaaactatgcggatccttatacactggccggttatgtgctgtccggtgactgccagtttgcggacgcggatgccgctttggaaaaagaattgatgaaggttaagaatgacacagatattgagacgtataccgagatgttccgccgcgcagatttcccatggaaggcgccgaaaaccacctccaaggattctgacgaagccgtgaaatttccggaagtgttcagctatgaggagcagggaaccatctatgtttccataccggtacctcatgctcttggcgattatgctctaataaagtacactcctgacacaaaatagtgaaaatagttgctatttaaccccatatttgataaaatagtacggaaaaatacaaagatatgaaatggggtagcaaaatgagtgaaaaaacgcaactgacaacacgagactatctgctcagcatccaacacctgtttgccatgtttggcgcgacggttctggttcctttgctgaccggtctcaatccatcgctcgcactgttttccgcaggtgtgggcaccttaatattccactgctgtactaagtttaaggttcctgtttttctcggctcttccttcgcatttctggccgcattaagcgccatcattcgaccggaaggtgctgtggttgcagaaaacattcctttagcacagggtggaattatttttgccggtctgatctatctgctgtttgcactgattgcgtttttaatcggagcggacaagatcaagagggtatttcctccggttgtaacagggcccgtgatcgtggtcatcggtatcaacctggcgagcaccgcgatcggtgatgcgaccggcggcctaagcctggcggacggccttacctctgagatcgccttaaacctgggcatcgccctgtttacgctcttcgtggtaatcctctgttccatattcgcacacggttttttcaaactggtcccgatcctaatcggaatcgccgcaggatacgttctgtgtattattctgggcgcggtcggagtcttccatatggattattccgccattacgtccgcagcatggattaatatcccctttgtgacaaaggatatgaatggagttccctttatgtctcttccgaaatttgagctgggcgccattctttccatcgcgccgatcgcctgtgttacctttatggaacacatcggtgatgttaccaccaatggtacggttgtcggaaaagatttcttaaaggatccgggtctccacagaaccctgatgggcgacggactcgcaaccttattcgccggattcgtcggcggacctgccaacaccacgtattcggagaataccggtgttctggccactacgaagaattacaacccgcgtcttctgcgtgtgaccgccatcttcgcgatcatcctcggcctttttggtaaggtaggcgcaattcttcagactattccgggcccggtcaaaggcggcgtagaagttatgctgtttggtatgatcgccgcagtcggaatccgctctctcgcggaatcggatcttgatttcactcacagccgcaatttaaccatcgtcggactgatccttgtattcggcctcggttttgcacagatgggcggactcaatgtccacgcaggctccataacgcttaacatctccggccttttcatcgccgttgtaatcggagtcctcatgaatatcatactgcctcaggcagccgatactgtaaaaaactaaagaaaggattcatataccatggaatatccaattgaaaatgtaactgtcttcagccacccgttaatccagcacaagatctctatcctgagggataaaagaaccggcaccaatgagttccgcgctctgatcgaagagatcgccatgcttatgggctacgaggccttaagagaccttcccttaaaggaggttgaggtggagacaccgatcgagacctgtatgactcccatgatcgcagggaagaaactggccatcgttcctatccttcgtgccggcctcggcatggtgaacggaatcctcgctctcgttccttctgccaaagtcggtcacatcggtctttaccgcgacgaagtcacacacgagcctcacgagtactactgcaagcttccgaaccccattgagcagagaaccatcgtggtaaccgatcccatgctggctacaggcggttctgccgtcgcagccgtggatttcatcaaggaacacggcggaaggaacatcaagttcatggccatcatcgccgctccggaaggtctggaacgccttcacaaaacccatccggacattcagatctatgtcggccatctcgaccgccagttaaatgaaaacgcctacatctgcccaggtctgggagatgccggagacagaattttcggtacgaaataagacaataaaactgtagagctgacagaagctgcaaaataagttccaaaaaaaagaaacgcaagttccggcaaatgctggttctggcgtttctttttaatcttctcttatccaattcctttgtatacaatgctcataataaacaccaggacggcgagtcccacgtaaatatattttgcagcaaagcaaaacagcttcccaaccggctttttccggccggtattcagttcctctccgatcctgtttattcccagaacccagtagatcatgatcgcgcagagcacggctccgaacggcacgacgtagatcgttatcatatccatccaggaccccatatacggctcatactcgataaaaagtccaatcaggaacacgagacatcccacgagaagaaccgccttcttccggtcgaaatgcaggtgagtctgaaccgcttccgcacacacctcgaacatgttgacgagggacgtgattcctgcaaacagcacggataagaaaaacagaacggccacccatcttccggccggtatctgcgcgaaaaccttgggaagcgtgatgaacatgagcggcggaccgctggccggatccatctgaaacgcaaacaccgccggaatgatggcaaagcctgcgagcagggccgccaccgtatcgagcagagcggtcgtcatggccgccttcggtatatcttccttcttgtctaaataactgccgtatatgatcattccagatccggtaatcgacagggagaagaatgcctgtcccatggccatcacccacgtctccggcttaagcagaagctcccagcgcgggatcagcagatactcatacccggcaagggcgccgtccaggaagaacacccgcaccgcgataatcacgaacaggatgaagaatgcaggcatcataatgcggttgaccttctctatccccttcaggacaccgcccaccagcaccaccatggtgattaccaccaccatgaaatgccacggtacgctgccgaaatggccggtcgcctgggagaaataggcctctgcctccatccccatcataactcccgacagagagccaaacaggtaacggagcacccagcctacgataatcgcataaccgatcgcgattcccagagaaccaatcagagggatggcgccgagaagtcccccgccccttctccctctgctcttcagcgcatagccgtaagaaccgatggggccggtcccagtcagtcttccgaatgcaaattcccccgacagccctaccataccgaatagaaagataaatccgaaataaacgagtaaaaaagctgcgcctccgtactgccccacgcggtaggggaacatccagatgttccccattccgaccgcagagcccacggaggccagtataaatccaagccgcgagccgaacttgccgttcttccccgcagtatgtgttttttctgacatgtctctttgtaccttactccttgattttatcgctggccttcctcattgggcggcctctttcccggcctttttatcggccttctttcttatgcttcctctgtttcgcgtttctctgccacttcgccctgcttcttgtagatgcagccgccgtcaacacagcctctcacgctggaaagaggatagatattggatttcggtccgattacggttcctggatttaagactgagccgcagccgacttccacgaaatcacccaggattgcgccgaatttctttaatccggtctcgatatctccatcctctgcgtgaaccttgaccagagtcttgtcagacttcacgttggaggtgatggaaccggcacccatgtgtgacttatagcccaagatggagtcgcctacgtagttgtaatgcggtacctggacgccgtcaaacaggataacgttctttaactcacaggagtttcccacaacggcaccttcaccaacgatgacgttgccgcggataaatgcgcagtgacggatctgtgcgcccttacagatgattacgttatcggccagacacgcggtcggcggcatcttgacggatttgtgaatccagatggatttgcccatgcggttgtattcgtcttccggaagcagctcgccgagggaggtaatatactcaccgatcttcgggaggatctcccacggatacgtatttctttcaaataaaagttttgctatggtatggctggtatcaaataagtcctggatttgcatatcttcttttttcatggtcttaagtctcctattttgtttttttataattagccgccgccgcatcaaaagcgccccgaaggccgtattgattgttcagccttaatacattggccgtgcgtccagcgacaaaattctcgagtttctgcatgtattcgtcggaggtaatgcttccctccgccacgtaggtaagccctttttcccagctggccgtcagctccggattcaaaagctggcggatcgaggcgtttactacgtcgaagatcatctcccctaagagtgtcggggtaataacctgggtcttctggttcaaagccagatatttaatattgaacagcttctttaaaatctcggcacgggtcgcactggtaccgatgccgcttcccttgatctgggtccgcagctcatcgtcctcgatcagctggcccgcattctccatagccagaatcatggaaccggaggtgtagcgcttgggaggtgatgtctctccctccttgatggccagactcttaagcgggattacggcgcccttcttcagagtccccagcatggcgataaattccggattatccatgtttttctgtgtggaatccgtgctgccctcctcggagtctccggaggcattctccgcctgtccgtcctttggtttggcatccgtttttttcttgcttcccggaacatccgccacctttaagtatcccgcctccagcatgacgcggaaattagcgtaaaagtgttccttatcgataaccagctccagtgcgtatttctggtagatggccggaggataaaagatgcttaaaaatcgtctggcaattacctcatagaccttcgcggaaagcggcgacaggcttcgtaaggcccccatgccctgtccggtcggtatgattgcgtaatggtccgtaatctgtttatcattcacgtaccgcgtttttgcaatccctttaaaggaaccggactccagtgcttcggccgcgaatccggccagcggttcaaagttctttaagcctccgatgttcttgtagatctccttcgccaccgcggtggaaaggactctggcatcggttctcggatacgttaccagcttcttctcatacagttcctggacgaccttcaaggtctcatccggactgatcttaaacatcttggagcagtcattctgaagctccgccaggttgtaaagaagcggaggattcttcgtctccttcttcttctcaatggcctgcagcaccgcattcatgggctgaaccgcggaaagtgcctcgattaaggcttccgctgtctttctctctttaaatccgttctccttatagagatacggggattcaaaatatctggagcccggggcacttttccactctccgtcaaaatccatgtcctgaggagagaacgtaccgatcacccggtaaaacggagtcttgacaaagtccctgatttcccgctcccgccggattaccatgcccatgacacacgtcatgacgcgtcccacggaaatcaccgtgttctttccggttcttaagtaattcgaaatattctgcccatactttagtgtgagcagacgggaaaaattaattcccatcaaataatcttcttttgcccttaaataggctgaggcggaaagattatcgtattccgtctcatcttttgcctccctgattcctcttaaaatctcttcctctgtctgggagtcgatccatacccgcttctgagccttatccttcacatcagccatctgggccaccagacggtaaatatattctccctcgcgtcccgagtcggtgcagacatatatcgtatccacgtccggccggttcagcagaccgctcacgattttaaactgtttttcgacgctgggaatcacttcgtatttaaattccttcggtaaaaaaggcagagtctcgagactccatctcttgtattttggatcgtagcattccggatagctcatggtaactaaatggcctacgcaccatgtgacaattgcctgttccgattcaatataaccatcgctgcgccttccgtttatcttaagcgcgttggcaaattcctgtgctacacttggtttttctgcaatgtataaagattttgacatgtatatccccactgatttctattcataacccgtctattataccattgaaaatccggaatatcaatgatacaattataaacaattctatttctattttattacgttaaagtgaaggagtcctattatgtctattgcaaaagtaaaagaatatctgagagattatggcagagactgtgacgtacaggagtttccggtgtccagtgccacggtggaattagcggccaaagcgctgtccgtagaacctgcccgcatcgccaaaaccctttcttttcatggagatgaaacgaacggctgtatcctgattgtcacagccggagacatgaagatcgataacgccaggtttaagaaacagttcggttttaaggcccggatgctgggcgccgaggaagtcgccatgctgaccggccacgaggtgggcggcgtctgcccgtttgccaatccggaacacgtgacgacttacctggatgtctccatgcagcggttcccctccgtatttccggcggccggaagcgccagctccgcgattgagcttacctgtgaggagctctttaagtattcacaggcaagggaatggatcgatgtctgcaaggcaaaagatgtacaggccatataaagaatgtccaggttatccaggttgaacttatgatataattgcttgtttctttatatgaacaatgatatactaacattggctgaagatggtaacgtgatacaagtaatccatatcaggaggtattcatatgttagaacatagtgatttgcaggcaatcagggacatcatgaaagaagaaatcggaaggtcagaaaatcttgttcaagatattataaagaccgagattggtggatcagaaaatcttctcaaagatattataaagaccgaaatcggaaggtcagaaaatcttctcaaagatattataaagaccgaaatcggaaggtcagaaaatcttctcaaggatattataaagaccgagatcggaaggtcagaaaatcttctcaaagatattataaagaccgagatcggcagatcagaaaatcttgtattaaatgaggttgacagagtacaggagaatcttgaaacgaagatggaacagctcaaaagaaatatggatgagttgacacagtattatcggacggtaaaactagatcatgaaaacaacgcccttttccttcagatgattcaggaaatcaaaaaagaagtgaatgaactcaaaatgaaaatcgcataaagattccaaatgaaagtattgcattcctggcaaaagcaagtaaaagaagaggcagtgaaaaagagttgatctaactccatttttagctgcctcttccgctcttatcgcagtttgtcattttaaacacatctttatcctgtatactggcttgcctgcatctgaaacatctccgcgtacttcccgtttaagcgcatcagctcctcatgatttccatcctctgtgatccttccgtcttccagaaagataatccgtctgcagaacttgcagctggaaaggcggtgtgagatgtatacggcagtgcgtcctcccgtcagttcactgaaacgctcatacacctcttcctccgcgtacggatccagagccgctgtcggttcatccagcacgataaccggggaatccttatacagcgctctggcaatcgccagcttctgaagctctccacctgaaaattccgtcccgctttcctcaaactgctttccaacgaatgtcttgcttccattcggaagagtctgaactttttcaaagatccctgcattcttaagcgccgattccaggcgtttctctgagacagccgttccggcagccacattttcttcaatgctgaattcaaatatcttaaaatcctgaaataccacggataagagcttccggtacactagagaatcaatcgtatggatatccacgccgccgatcaggatctgaccgccagtcggtttgaacaatctggacagcagcttgatcatggtggtttttccagcgccgtttcttcccacgacagacaggctctcgcccggcttcagttcgaagttcacatcacttaagatgtcgcggtctgttcccggataccggaacgacacatgacgaaattccagagttagctggctggtgtcaatgtccttttggccttccatctccgtttccaccggaatctcctccagtttcacgaattcttccaggtaacggcagtcctgtctcaaacgcacgataatattcagcagatttgctgtggaactggaaaatgtcgccgccgctcccgtatacatactgaagctgccaatggtaataccggtcagcaaagccttcacgccgatgtatccgtacacaaacgcactgcggaacgcctctaaaatcctggaaatcccttcaaacctccgtttcagctccatggtctgcttcttgaacttgaatatgttgtcgtcacattcgttattgcgcttcatcagcagttcatggaggcgaaacagccgaatatcctttccaggtccaaaatcttcgagaatctgatagtaatagataaagaagcgctccatacttacggattcttcgtgaatctccatctcctttttctgatatcctttgttgagccaggcgatcacaattgtgggaatcatgatgactatcaggctgatcacatcgaagcttaagagaattccaacggcccctgctgccgtaaggacacagcggatcagttcgggaaactggcgcacaatatagagatgagtcattcgttcccggatgggaagcatggctttatccttctgctctatgtacttcgtatcctccagattctcgtaggccacccccatgttgtggctgccgatgtcatactcaatcttaaccagaatatcccttgtcaccgcattcatataccgtttcagtgcgcctgccgccatcgttaaaaacagcgctgataacgcggccgccgccacatacccggccagaagggaaagacgtttctctcccatcatctcatcgatcatgtatttgggaaagagtattgccacaaatggaagcgccgcctccagcatggattccacaaacgcggccagaacgtagcctggcgatgcctgaactacttttttagccagaaatttcaaattataaagttctttttttatgttatgcttcatgcgccgcctccccctcctcataatatttcttctgagccataaacatctggtaatactttcccttcttttccagaagttcctcgtgagttcccagctccgccacacgtcctccgtcgatcagtgcaatctcgtcacagaatctggtggaggccagtcgatgggatataaacagcagtgtccggccttttgaaatttctgccagctcatggtacagagtatattccgcatgggcgtcgagggccgccgtcggctcgtcaaaaatcaggatctttccatttttgtaaagtgcccgggcgattccaatcttctgtttttctcctccggatacatcaacaccgtcatggtagagatactttgtcagcggaagatccggattcttcccgtgctgttcataaaacgccgaaagcccggcttcctctatggcggccaaaaggcgttctccatccgcaccgccctcttcacaggtgatattttcctggaaggtcatggcaaataagctgatgtcctgaaatacagctgccagcagatttctgtagtcctgaagtgcaaaacggcggatgtcggttccatttagaagaatctccccctccgtcgggtcatagagccgtgtaaccagcttgaccagcgtcgtttttccagcaccgttgataccgacgattgccagtttcttaccagcttttatcgtaaaattgaaatctgtatacacattttcatccgtccccggataatgaaagctcacatggcgaaaggtgatctcatagtgatccgcctgcggaacgggtaccgtttctttcggtccgccctcatcctcattgggaaggtccagaaacgttctcatctcgtcaatccggaataaatcgccctttacaaatgccatatcctcaaataccttttccagcgtaaccgtaagtgttgctgccgccatgaaacacatagtaaaatcagcaatggaaatccgtccctcaaggacgctgcagatcagatagctgtaaataatgatatcacggacgcaggaaaggatgctttctgcaaggtctgcaccataatggtgtttctggatatccacatcaatctttcgtctggatttgtggttaagcatcagcttctccagcaaaatgttggagaggccgtagattctcaaatcctttccataagccaggttgcccatgacattcgtcaggtagcgctgacgcctcccaaacggtgatgccttccttgatatctccacctcatacttactggctttttcccttaagagatagactatgtaaatatcagcgatcagcaggagaacgatcagaaaattaagttttcctaaaacacttaaataaaacacggctgagacaccatttgccgacagcacaaataactgggtcaaaattccctggaccccgaattcgatatcggaggtggccgaggtgacacgccagaattcatttaagtatttggggtcttccagcttttcgtaccgtacccgcatgatcttttccttcatcctgctgataaaggaataccggaaacgggaaatatccatctcatatccggccttcacaacggctgagatcgttcctgccgccgcagttgccacaaaaaagactgcagcaatcgtgatcacggtcttcactctcgcttctcctgtcagctctgcgattaaatatctgggagtaaggatcgccgccgccgacaaaatcagtgtaaacacgatgtttaaaacaaaataaaggtacaggattctcttgctgcgccacgcttccttcagcaaataaaggaagttccctctgcttttcttttttcttttcatactctcactcctgtcagactatttttatgatctttccccactccttcaccagcattaggtaaatttgactcccaactggccaggatcgaaaaaagtgctgcaaaagccttatttccagtgtttcaattcattggaaacaggttctttgcagcactttcctataatcttttcaatcgttaatactgggaaatggtccagcctctaaaaccgtctcttataagctctatgaagattataaaaaccggatgtcgcccatcttccgcggcgccgttctctgatatttcacggccggataccccagaagcatacagcaggcaagagttctgccttcgagtcccagccactccatcagtttcgggctcacactgaccgttctctgcagatagccgctgtatagggcgcctgcgccctcggccaccgccatattttccatattggccgccgccagacctccatccagcggattgtctgctgccgtaatcagcaggcacggcgcattaaagaagaaggtgtcatccttggggtccttcttccatttctcatagaaacgcgtaaaggcgcgcacgtagtccggtttcgtctcccgcaggatctccagaatgtagggaaattctgaccagaacagttccttaaactcggggaggcgtgtctgtactgccacaaaggtacatgcctgtgcgttcttcgccgttgccgtatagcgccccgcttcgatgatctgctccagcacttcccggctgatccgtgtatccttatagctgcggatgcttcggcggaattttaccgcgtgaagaaagttttccggagatacggtgaacgaatccttttgatacgcttccacccccgccatatcatactccggtatggaaaccgcctcggagggacagactgccacacagtggccgcaggtgatgcagggccgtttgacagcggcctttttctcgtttaatacaatcgcgtttcccggacagtcctgcacgcagagaccacatccgatacaccgttcttcatcaattataactgcactgttcatcattcagttctccttttcccacttcattttaagatgccgtttttttcctgtattcggagagaatcactgccgcaaacatgaatacacagccggccatcagccggactgtcagcggatctcccaggaagatcacggaaaagataagaccgaataccgattcaaacgataagagaatggatgaggtgttcggcgttaaatatttctgtcccacattctggagcaggaacccgatcattgtgctgaaaatccccagatacaaaagaccgatcatcatcgtgttgtcaattacccctccgtcaaacggcccttccagaatcggcgcgataatccagctcagggccgcagccaccaccatctgcagcaccgtcatcgtgaccgggtcgtgatccgtcgtatagcggtcaataaatacgatgtggaccgcgtagaagaagccgcagatcagggtcagcaaatctccgaggttgatggataaatccccttccagcgacagaagcgcaaggcccacaaccgcgatacaggcggcgatgacattatttctcttcggtttcttgtggttaaagaaccagtgaagaaatggtacgaggatcacatacagtgtggtgataaacgcatttttgctggccgtcgtgtactttaatccatacgtctgaaagaaatagctgacaaagagaaacacgcccagcagtcccccgcagaataaatccgatttgttgatcttcatcacctttctccagaataccaggatcagtgcgatagccgctatggtaaagcgaagcgccagtaagtaggtgggggaaatgatatccaccgaatttttcatgacaacaaatgcgcttccccagatgatggtcgtgatgatcagcccgatggctgccagtattttgattccttttccgtcttttgtacccataggtcttccctaatgtcctttcacatacacatgggctgccaaggccggattatggccgtggcagccctttgctttctatggtgctgcagtgtttaaagcgttaccagcgtgtaaaacggtatatcgtagtagtccggtattcctctcccgctttcagtaccggtgaaggaaattccggcatattcactgcgtttggatagtactgtgtctcaaagcagtagccgtatctcggggcatataccataccgttcttgccggccggacctgcgccgaggaaattgccggtgtagaactgcattccgggaaggtccgtgtagacctccatgcggatccccgttttgtcagattcagctgccgcggaaagttcggtctccccggaagcgtggtttaagatccagttatgatcgtagcccttgccgagaatcagagcctcatactcctcttcgatgtcgcggccgatcaccttcatggcagtgaagtccataggcgtacctgccaccggcacgatctctccggtcggaatggagcctgcgtccgccgccgtatacgtatccgcgtcgatccatactctctggctcatggcatttccgccgtcctggccatccagattaaagtagctgtgattcgtaaagtttgcaaccgtatcgctgtcggaaaccatatggtaagcgatgaccaggctgtcatccggtgtcagcgtgtagctcaccgtgatgttggcgtttcccgggtatccctgatcgccatcgggactgaacagcgaaaagctgatgacggttccgagagcgccctcctctgtctcggcctcccagagacggtcgtgatacagatccggcgcgctgtgcaaattgttcgttccgtcgttagccgccagccggtactctttcccgttcagcgtaaacttcgcccctgcaattcggttggcgttgcggccgatcggtgctccgaagtgaggcggattctccaggtacgcctccacactgtcatatcccagaaccacatcgacgagttttccgtctctgtcaggcacgttcatcgtcacccatgtgccgcccaaatcggtaaaagaggccgacacgccattatcattatacagcgtatagagagtgaccgcttctccggaaggcataactccccactgttctttcctgtaagccatttcagctacctccgcgtttctcttatttgtgtcactattttgcctgaatatatccctgcgccgttaaaagctctgcgcagagcaccgcgccgccggccgcgccgcggaccgtgttgtgggacaggccgacaaatttataatcgtacaccgtgtcctcacggagacgtccgatggaaacacccataccattttcaaaatccacgtccatggtaacctgcggacgattgtcttcatacagatactggataaactgctttggagcacttggaagctccagttcctgaggaagccccttgaagcttacgaggcgctcgatcaattcctccctggtcggttttctgcggaatttcacgaaaactgcggctgtatggccgtttaagaccggaacacggatacactggcaggtgataaccggctcgctcgctttgacgatctctccgttctctacctttccccagagtcttaacggctcctgctcgctcttctcttcctcgccgcctatgtatgggatgatgttgccttccatctcaggccagtccttaaaggtcttgcctgcgcctgagattgcctggtacgttgtagccaccacctcgtacggctcaaactctttccaggcggttaatacgggagcgtaactctggatggaacagttcggttttacagcgatgaaaccgcgctctgtgccgaggcgctttctctgatccttaatcacttcgaagtgctccgggttgatctccggtactaccatcggcacatccggtgtccatctgtgcgcgctgttgttggaaacgaccggtgtctccgtcttcgcatatgcttcctcgatcgctttgatctcttccttcgtcatatcgacggcgctgaatacgaaatctacgctggaggcaactttctccacctcgtttacgttcatcacggtcagcttctttactgcttccggcatcggagtcgtcatcttccagcggtctcctacggcctcctcatacgtctttccagcggaacgggggctggcagccacggtcaccacctcataccagggatgattctcaagcagagaaagaaatctctgtcccaccatacctgtcgcacctaacacaccaacctttaacttcttttccatagttttctcctcatttcatttcttttttcagactatcctataacaaagttaaaaaaaaatcaaggtttattcgtcacaaaaatacatttgtacgcctatgagagacattttcctggaatgtacgtcctggaaaagaatcgcacgcttttattttatgattttacagcaaatataattcccagcgtgtttgggccgcagtggctggacaccgtacatccggcctccgtcaccagtatctccgaaaagattccccggttccggatcagctccctggcttccaccaccaccgcctccgggcaggccgcatgggtgagaaagattacgtccggtacgcagcgtccctgcaccgcgtcgagccgttccccaatatattttctcacacactgccggaacgagccgcggtactttctgtccaccgccagttccccgtccctcacgctgatgctgggcctgatgttcagcagattggcgccgaacgcggtaaccgccgaacagcgtccgcccttccgtaaataatccagcttgtcgatgacaaagctcacatccatgcaggtcttcaaattctccagcttcgttgcaatcgcttccggttccatgccggcctccgccatctttgcggcggctacggccagataaccgattccggtggtaagattcatggagtccaccaccgtgacgccaggaacttcctccgcggccagaactgcgttctgataacagctggacagcgccgaaccgatggtaaaatgaatcagcgcaccgcactccttcctaagctccgtaaaagcgccgcagtactccgccgtattgatggcggtcgtactgcagatctctcctcccgccgaaacatggcgaaagatatcggccggtttcagttcgattccatcccggtatgtccttccctccataataatggcctgagggattaccgtaattccatactgttctgcaatttctgccgacagatcgcaggagctgtcggcagatatccctattctcttcaccgtgattcctttcccgtggctgccgcaggctctttcttatgaaagacggaccttgctgccctttccgtcacgctttccgatctttaagcggttcaaatgaacttccttcttcttgtattcgaccaccggatcctctcccagtaaatagaccgtctccagttcctctccctgggccagcttaatgccccgaacgcctctggaattcttcttcatctcaggaatctcttccagtgcaaaacgcaggaatacgccgcttgaggtctgaagcaccacctcggtctccgcccggagaactaaaatcgataccacatcgtcgccttctaaaagcttagtagcggctacggtcctgttgtttgtctcgaattcctctcccggcactctctttacgagcgcctgcttcgtggcgaagaggaagcggctgcccttcatggattccgcgctgcagagatagataatctgctcttttgtgccgtcgtacttgcttaagttgtcgatcggcgtgcccttgtccctcagctttccgtaagggatatcggcggccttcacctgatgcaggttgccggtattggtgaaaatacagatcttgtctgtattgaagcacgataccacgtgaacgttctccgtctcgatggtctctctgttgcggtcgtatgtggacttgtccagcagcttgcagtagccgaaccggtccatgacgaacaccacctccgagacggccacggctgtctcatcgtaaacagcttcttttccatcctcgatgagcgtgcggcgcggtgtggcaaactcctctttgatggcctctaagtccttcttgatcacgacgtccatattggcccggctctccagaatatgctggtactcggcgatcttcgccatcgtctccttatactccttctccagggccagaatctccagaccgatcagcttatataaacgcatctctaaaatggcgctggcctgcttctccgtaaaatgaagctcccccgcctccttttcaaatccggctgtccggaatttgatgttggagatatctcctgtcatcaggcaggccttggcatcctttaagctcttggagcctctcagcacggcgataatcagatcgatgatatcgcaggccttgattaagccttccttgatctcctttttctccagttccttctccagcagcgcctggtatttgcgcgttgcgttgtgatactggaagtccaggtaatttttgaggattccctttaaattcagggtctccggccggccgccggcgatggcgagcatgttgacgccgtacgtatcctccagcttcgtcttcttatagaggatgttgcggatcttttcaacatcggcgtcttttttcagctccagcacgatgcggatgccgtccttgttggactgattggaaatgtccaccacatcggtcagcttctttgattccaccagttccgccacgtccacaagaaacttgttgatacccgcgccgatcatggtatacggaatctccgtaatgaccatcttgtccttgtcagccttccgttttcccagttcgatatcgatctttccgcgaagcttgatctttccgcttcccgtctcatatatctctgcgagaccgctcttattggcgatgatgccgccggttggaaaatccgggcccggcatgtattccatcagttcccttgttgttatctcaggattgtcgatgtaggctctgacgacgtcgatgacttcccccaggttatgaggcggaatgctggtgctcataccgaccgcaattccctccgcaccgttaatcagaagattcggcacacggaccggaagcacctccggctccttttccgtctcgtcgtagttggggataaattcaaccgtcttatccagatcctttaaatagacttcctctgcaaacttctccagcctggcctccgtgtaacgcatggcagccgcgccgtcgccctcgatggaaccgaagttgccgtgtccgtttacaaggggcattcccttcttgaatacctgggacatcacgaccagggtttcatagatggagctgtcgccgtggggatggtacttacccatagtatcgcccacgatacgcgccgactttctgtgcggcttatcgtggtttaaccgaagctcactcatatcatataatacacgccgctgtaccggctttaatccgtctctcgcatccgggattgccctggcagtgataacgctcatggaatagttcatgtagctcttctgcatttcctcggaatattctgtttttacaatcttctcagccatgttccctctccttacgcatcaatctctgcttcatccgcatgctcgtaaataaaccggcgccgcggcggaacttcgctgcccatcagcatctccgtgatttcggaggccatgcgggcatcctcgatctccacctgcttcagcacccggtgatccgggtctaacgtagtttcccagagctgctgcgcgtccatctcaccaagacctttgtagcgctgcagcgtaaaatcaccggtgtgggtcttccggtagcgctccagctccttctcatcgtaaaggtactgttcctcgccgcgcttcggaatcaccttaaagaggggcggcatggcgataaacacatggccgtcatagatcagttccggcatgaaacggtagaggaacgtcagaagcagggtgtcgatatggcttccatccacatcggcatccgtcatcagtacgatcttattgtaacgaagcttggaaatatcgaaatcgttgccatagccctctgaaaagccgcatccgaaggcgttgatcatcgtcttgatctcggcgttggccaataccttgtccatggaagccttctccacgttgagaatctttccgcggatcggcagaatggcctggtacatcctgtttcgcgcagttttggcagaaccgccggcggaatctccctcgacgatgaagatctcgcatttctccgcgtcacggctctcacagttggccagctttccattgctgtcaaaggagaatttcgacttggacagcatgttcgtcttggccttttcctccgcctttctgatctttgctgatttttctgcacaggaaataactgccttcagaatctctaaattccggtcgaaatagcgctgcagttcgtctcccgtcactgtgaagaccgcctttgtggcatcggcgctggccagcttcgtcttcgtctgtccctcgaagatgggatccggatgcttgaccgcgaccacagccgtcataccgtttctcgtatctgcgcccgtaaagttggcgtccttctccttcaatatccccagttccttggcatagctgttgatcatctgcgtaaaacgggtcttgaagccggctaaatgggtgccgccctcctgggtgaaaatattattacagaagcccagaatgttctcctcaaaggtatccacgaactggaaggctacctccacctccacccggtcgatggtgcctttataatagatcggatcgtgaaccggagcctttccggagttcagttcctttacgtaagagatgattccctccggctcatggaacaggacggtctcctcctcacccactctcttattctgatatgtgatctgaaggttgggatttaagtaggccgtctcgtgaagacggctcttcagccagtccgccttaaaacgggtcttttcaaatatctctccgtccggcaggaaattgatctcagttcccgtctccttcgtccttcccagcgtaggaagcaggccatccaccagttctaccgtcggaatgccccgctcatatgcatcataatgaatctgaccgttcttatatacctttacgctcatccgttccgaaagagcatttacaacagaagagccgactccgtgaagtccgccgcttgtcttatacgcatcattatcaaatttgccgcccgcatgaagggtggataatacaattcgctccgcggacatgcccttcttatgcatctccaccggaattcctcgtcccgcgtctttcacggaacaggaaccatccgcttccagtgtaacccagatctggttacagaagccagccagatgctcgtccaccgcgttgtccacgatctcatagatcagatggttaagccccttcgtgccgacactgcctatatacatacccggacgtttccggaccgcttccagcccttccagtacggtaatactgtccgcattatactgtgttttcgccatgatactcctccacatcttgtattgtcttttgctattatacaatgaaattcctgcacttggcaagtttttaacacattttttaaaaaagtattgaaatttataccagagtcgtgctataatatatgacgtgtcagtaaactggctaagcagatatagttcattggtagaacatcagcttcccaagctgaggaggcgggttcgattcccgttatctgctttttttattgcccaaatattgatttatgggcatgtattttattttcaccacaggaactctccatgacaaaagaggatttccgctcattcaaatgagctggaaatcctctcagactgtagacaactagcctcctaataggaggcggttgtctttttttctttaactcaggttttcgatgtagtataatagtactatacgaaagtgaggttttttcttatgatggggaaaaaagattattcagaacgttctcaggtgcagattgcaagcctggatgacctcgtcccttccggtcatctggttcgcaagctggaagaagccattgatttaagctttatttatgacgaggtcaaagatctctacaaaccttatggcagggaaagcattgatccggttgtattaatgaaaatcgttatcctccaatacgtgtttggcatcccttctatgcgcaaaaccatcaaagagattgaagtgaatcttgcttaccgctggtatctgggatacggcctgtatgaggatatccctcatttctctacctttggaaagaactataccagacgatttaaggatacggatctttttcaaaagatattctcccggattctaatggaggtggatgcctgtggtttcctggatacggaaagcctttttatcgatggcacccacatcaaagccagtgcaaaccctcataaataccagaatgaaaccatgaaaaaagaagcccggtgttacgaaaaggagctgctggaggaaatagagaaggacaggctggagcatggaaaaaagccattgaaagaaaaagagtccacgccacagaccataaacaaaaaggtcagcgctaccgatcctgacagtggctggttccataaaggggaacacaagcaggtgttcgcttatgcagccaatacctgttgtgaaaaaaataattatgtcatagattttgaagtgacagcggggaatgtccacgacagtgtatccttctgggaactgtaccggagagtaagcggacgggtaaaatatcccaaatactatgtaatggatgcaggctataagataccggcaatcgcaagaaggctaatcgaggatggaaaggttccggttatgccctataaacgcccaatgacaaagaaagggtattttcgaaaaagcgattatgtatatgatgaatactttgactgttatttatgcccaaataaagtacagtttacaagggactacacagggtaacggtctgacgggaggtgtgccgcccgtcagattttccatgtgatgttcaagctgtcacttgtagcggcaacggtggtaatcatcaaatccaccacacgccgcttgtcatcaaaggatacattgtcccatgtgtcgaggtagccggaaatctggctgacctgttccgggctgatggcttccaccgtcaactccgctatcctcgccagaagttcctgcttgcgtccgtccagttccgctatcttcacattcacataggagagcagaacattgtttgcacccgtcagactgtccaccagcttttcaatctcgctgtccacatggagaagttccacttgcagggcggcgattttcgggtttgcctttgccgctttttttctgcccgtcagcgttttgtagcttgccagcttcttcaccatctgctgataaacaaccgcttccagctccgaagtgatgattttcccgcacccggcacagcttttattgtccagccgctttgtgcagcggagatattgctttcccacaggattgttaatgctcataagggcatacccgcagtttccgcacttgatttttcccgccagccatgtatgggtggctttccgggcagactggattttcatgttgttcatcagcttcttgcggcaggtcagccagatgtcggaggggacaatgccctcatggggagccagcaccagcatttggtctttcaagtcgttctttttgctgggcttcacatcccgcccttgatacagatagcagccattcatgccggtaaaatcggcagcgtcattgacaatgattgtcccttgacttttgaaaaattcgtacacatcaaggtctgcctgcacatagacaggattgcgtaacatctgcgccagcgtggggcgtattagttccttgccgttgaataaaattccctgttcggcaaagtaccgggtaatgtccccgtaggaggttgtgggctgggcgtacatctcaaacatcagccggatatttgccgcttcctccgggtttaccaccagcttctttgtgttgataccgtccatcttaatcggctctgtatggaagccgtaaggggctttcccacccatcttgaagcctcgctggctgcgggaataataagcgtccgtcacccgcttctgtatcgtttcccgttcaagctgggcgaacacgatacagatattcagcatcgcccgccccatcggggtggaggtatcaaacttttccgtagaggacacaaactctacattgtactgttggaacagctccatcatattggcaaagtccagaatggaacggctgatacggtcgagcttgtaaaccacgacctttgcaatcaagccccgcttgatgtcccgcaccagttcttgaaacttcggacggtctgtgttcttgccgctgtaccccttgtctgtgtattccttgcagttaccgcctttcaactcgtatttgcaaaattcaatctggctttcaatggaaatgctgtcctttttgtccaccgattgtcttgcatagattgcgtctattcgattattcatattgtcgctccttttcttaaaaaagaaacggagttgctgacagctttattataccgccagcagccccgcaaatcaacgatggcttcggaaaatcttatgccccggcttcctcactctgccgcttgtcggcatacttgcggaacacctcataaagctgctgttccagctcccggcgttttgccgcttcctgctccggcgtgaacaccggggagagattttccagcgtgatttcctttccctgaaaagtcacgacttcggtttctttcttgtatctgatatgctccatagtacctccgtatttaattttcaaagtgcagtgccgccatgctgcggcgtgaaatgttttctgtcattgatcaccgttcccttgtgtgtcgctgttgccgtttcaattctgccagcacctccggcgggatacggtctaccagccgctgaatgtctttcagctcgctttccagctttgcccgttccatcgtatctttcatcttgcctttttcactggctttggctctggcttccaactgttcattttctgctaaaaggtcgtttattgtgaccttatattttttgagctgaccggagaagttctccatctgcggaaaccactttttcagcagggagagggcttcctctttcttctttccggcattgaacggggtaataccgtccagcgtggcttcaatggctcttgcctgtttggagagattgaccgcctgcttgaacagacgggtggggatatgcttcctgcctgtcttgctggcactttccccacgctccaagtcgggatatttctccaccatataagcgtgaaaatcgtcctgccattttgtgaggttggctctattccctataatctcctttgcacacaggcggttgtcctctgtcagcgggacaaagaccaaatgcaggtggggcgttttctcgtccatgtgtaccaccgccgatacgatattttctttccctacccgcccgattaagaaatcagccgccctctggaaaaattcctgtatctcctttggggacttcttcttgaaaaactccgggctggcggtaatcagcgtatccacaaaacgggtgctgtccctgcgggtgcggcagccagcttgttcaatgcggctttgaatgaagtggtaatagcgtccctccggcttgacgatgtggaaattgtacttgctccggctggtgtcaatgtcgggattgctggcgtactgttccttttgccgttcgtgatgggcttccagcggtcttgccggattgcccttgtgtttttcaaatcgcaaaattgcgtgttgtgccatgaaactcctttccccgttccgttcctttccgggacttttccacaggaaaatcccgcagaaaatatctcggatcggataggaatggataagatataaataaaatcgttttaatctctgtatttctatataccgtccgattttcgtacttcaagaggattgattatcgtacttgtggagtgcggttttcagtcctccggcgttccataaccgtatttcttgaagtcggtgtttggaaccgcttcgtaggattttgggtaaatgcgattgggttttccacagccctgcttctggatttccaccagtccggcgtattgcagttcccgcagggtgttgaccgctttctgccgcccgcagtggagcagctccactacctcgttgatgggatagtagaggtaaatccgcccgtattcatctgcccagccgtttttccgggacaggtctgtccggcgcaggataaaggcatacagtacctttgcttcgttggacaggggcgtgaatgtgggggcttcaaaaaggaaattgggaagccgggtaaagctgaccgctttttccggctgatggatataaatggtgtttgtcatattgtgttttgtggacggttagaagtccgttttcggaggcagacggtagtttctattgcctgcccctgttctgtgcttgtaaagccttgtaaatcaaggacttttcagcccctaactgtccacacaagacctccttttccgttcactttctgttttctgccgcctgtgaactctggcggcacagtcgggacagtatttcgcccggttggactttgggacgaacactctgccgcagaccgcacagcgttttagctccttatcccggaaaatctccgcttccagcgtcccgatttgcggcaagaccgaccagcggaaccacttacagcagaccgagaaagaaacggtttgggggcaagtgtgggtgtccccatcgtcaaggagcatacagttcccgtcctcataacagcagcactcccggcggatcagggcgtttgcctgtttcctctgtgccggtgtcatgcgggaaagggaaccgtcttgcttacgctctatgggcggcagtcgtttatatgggttctctctcatgtgttccctccatttttccttagccgttctccccgaaaaggcttcctgccccattcctgcggcgtgttccggcgttggcacgctccccggacttcgggacattttggacctgttgacaaacgcctattttgaaaaaaggctttgattttcctgcccggtctttgccgattttatggcagaaacggctttttcctgaacttttttcaagacggtttttttagaaaaccactttgtcaacagccccattttgtcccgaagtggctcgttgcggtgcttcccctgccggggtattccttttcggacggttattcatttttcaaggtgcagctcatcgatgaactaccataagtctacacctaaaagaccgcccgccccgtatatccataaagtcggaaatcagcccggaaaactttctatttccacgctctcggaattgtggtagaatagaaataatgagtgataaataggagataggaaagcctttataaatggatatttgaaaagatatattcattttcacgatggaaaaatggaggaggcacaatgaactttaacgaagcaatgcaaatgcttggaaacaagttgcaaggaaagtacggacatttaggctttaagtataaaaaatctgacaaaacacttacgaggcacagtaaaaatttcacctatatgattgcgttttcctcattcggcgggaacacaaaggatagcataagtatagaggtttgctatataatcaacactcgtccatacgacccttatggttatgccaaaccagacctcaacacacaaccgctgttttacagtttaagagacaatgaaatatatcttgacataggaaatgaagaaaaaattgataatacctttgagattgtttgtcagtggatggataaattactgattccaaaaatgaatgagctttgtgctaccgagtaaaatgagcagttgacaatatcagtgaattatctgcgagaaaattagaaatatttttgactatcaagcagacaaggagggggagcatggaactatccatacaagaacgattgaaagacctgcgtgtggagcgtgggctgacgctggaacagcttgcagagcaaacacatctctccaagtctgcgctgggcagttatgagggggataatttcaaggacatcagccattatgcccttattgagttggcaaagttttatgaagtgactgttgattatctgctggggcgttctcaaacaaaaaatcacccaaacgccgatcttgcagacctgcgtttgagtgatgatatgattgaactcttgaaaagcgggctggtggataattccctcttgtgtgaactggcggtacacccggatttcccccggctgatggctgacctcgaaatctatgtaaacggtatcgctggcaaacaggtgcagagtgcaaatgccattatagacgctgtgagcgcgaccattatgaagcagcacaatcccggcttgaccgacccgcagttaagacagcttatcgccgcccacattgatgacgacagcttttgccgctatgtgatacagcaggacataaacaagatagctcttgacctgcgggaagcccacaaaaatgattttttcagcgtcccagaggataacccgctgaaagattttttacagaccgcagacgaagtcgccagcgaggacggcgacccggaacaagcgtctttggcgtttatctgtaaacggcttaaattgaatttgaagaagctgtccgaggaagaaaagaagtggctgaaaaagattgcacagaagtcggacttactgaaaaatccaaacccacagcgagggaaaaaatagagaacgagaaattggagggagtaaaggtgcaggaggcaattataaaattgaaacttctcggtcaaatgccagacgcagtgaaagatgaccctacagaagaaaccatcaacatgtatgacgaattgctctccaatgtaaaaacgccattgacaagagaagaagtaggcgtattgattgacatttttcccgaaggtggaatgtatggagtagagtgggatttgctaaaattggtagagtcttatttgatagaagaaccatcaagtgaagagtatcgaaaattgattactgcttgtccaagtgaagaatggcgagaaactatgcaagcccgtttagataattgggaaaacaacaaacaataacttgttggggagatagcaaagccagtcgagccagtcaacggtcaagatgaacggcgcatttcatgcgccgccgttgacagtcccgtccgtctttgctgatgggcaatcaaggcgggaaagccctaaaatggcttcccgcccatttctaagaactgataagtcagatttgctgaaaaatccaaatccacagcggggacggaagtagagaacaataaataagaatttacaggaggaaaatcaatggagaacttgattaagtttttagaagataagataacggataaaatgtctgtggaagaaatagttgatgtttttgagcagatgtgcagcacaccgcttgaagaagatatggttttatttgaaaccggaacatttactgctttttcaaaagaaccattttttcaaatttcattagttcgacagttttcaaatgatgatgaagagttttatcaaatccatgtagtcatcttgtataagccaaccgctgaaaataaaattttcagcgaaacaacatgggacgaagatttagacgaaaatatatttgactatatcagaaaatcagcgtcgtttgcttatgcaagaaatcatgaatacatcgagataaaaatatatatggacgaaacttaacttctcatttatcagggagatagcaaagccctaaaatggcttccccgcccattccaattttgagagaaaaatctgtttgctttttgtgagtgtgtccacaagttcgggacattttgtcccgaagtccggcgtgggacgaggaacgggggctttcatatacgccctgtctgctgacgaaaccagccctgcgcttgcggctccacgacacgcaatcacagccctgttttcctgctgcttcaaatgcccttgcccgacccggcggcaacctcattttcgcagcaacgccgacagagcgtataacacactacactttgcaagcaaagtcgtgtgccaaggggcaagcccctttggaaaccccggacaacaaaacaggctgaatatctcgcactttttcggtgcttgatactcagcctttatttgttgtcagcagcccccgtttcgtggtctgcgtgtagttccttgtaaactgacctaaccagatactaaaatacagcacaacaaaccgtgatggataccgagaatacaaaagcgaaggaaaaaagtgtaaggattgtccgtaccaaaaccaatgtacaggaagcaaagaccatgtaaaggtggtaagccgccatgtatgggaggggtacatggaagaggtggaggagatccgtcatcagacagggatgaaagaaatctatcagaaacggaaagaaaccattgaacgggtctttgcagacggaaaagaaaaacatggaatgagatatacacagtacagaggattggcaaaagtgacaatggagctgacccttttatttgcatgtatgaatctaaagaaactggcaatctggaaatggagaaagggtgggctaaggaaaccctgttcttttgtctggatattcgaaccaatatatttatatataaaattcaaaatggttcctggtgcgatgcacccggaaccattttgtctacagtctgagaggatttccgctcattcaaatgagctggaaatcctctttttttatcagggtgtgtttcacatcctctttgatctttaattatatatctccgaaatctttccttcgttactcttcgctgctccagtccacatcgtattccttttccagcgaaaaaatgcttaacatatggtccgttgggtcaaatgacatgaaatattcatagtcttcccccttctgcagccacatatagtcatcgccgctgaaatccggaaacatctctccagccttctcccgggacatctcactgacaggcacaccgttaaaggcgatcctcttcagttcgctctcttcgccgctgaccaggctgaattccagacgggcgatcactgcgtctcccatacgaacagccttttcatccgtaaccagggaaatatgggcaaagatggaatctgtaacccagatcgatccgccggtatagtaagtattaggctccagctcggcctccgggtcaatctcatactgattgatctgtttgtcctccgtcatctcagacaccgtcacattcattccctgatccaaaagtgtctgtaccgtggtctcaccgaccagaatctctttcccgtctatcgcaaccggatacagcacctgggccggttccgccgacgcggtctcctcttttccgttcttcccggaacagccggataacagcgccgctgccgcaagcaggatcatacctgttttaaaaactcttttcatcactcgcatccctctttttttgtaataacataaaaacccctgataaaatcaggggtttacagtcagctcccggccggacttgaaccggcgacccacgcattacgaatgcgttgcgctaccaactgcgctacggaagcagctttgtttgtcagacttaactgtcggaccttagatagtatatcagcaaaggggaaaaaaatcaaccctttttttgaaaaaattgtaaatagcgagaactgttacaattgatgtattagttgcaaaaattagggtgaaaagttataatgaataacagtagaaacgtccccaaatgactggcattggataaaaggtgatcagatgaaggaaaaagaacccgtcagaaaacacattctggtaagcggccgggtccagggcgtcggcttccgctacaggacctattatctcgcccagaatcttggtctgaccggctgggttcaaaacctggatgacggccgtgtcgagatggagcttcagggtgatgaagcagacatgaaccagcttttccgaaggctggagcaaaacagttttatcgatattacggactgtgtggtaaagcagattccgacggaacgggaaagcagttttcacgtgcggtagcttccatatttttccagcttcacctctcccataaagttgtatagttaccttatgggggtgaattgaaatgcataaaaaaggagaaaaggaactggcagatttattcgaccacgccgctgaaagcgacgatcccgtaccaccagcaccggacgatgaatttcagacgattttggctgagatgaaacgccgggggattgagccccggattcgcagggagctgaaggaaaagaaataggcggtctttacagaccgtctgtttctttttccgcgtatcccgccacctctttatcccaggacataatgtggttctgaagccactcctccacgttctttctcacagcctccacgaaggcctcactcggtccttcctcttcctccagcatgatccgcagttcctccacggcccgcttaaatttttcatgctcccggtggtgggccgaaagcttcggatacccgctctttttctggagcgcttcctcctcggaaaaatggtaatccgtataatccagcaaaaaatcgagcgttcccaccgcggttctcttttccgttcccggaacgcactcctccgccagtttattcacccggctgatcagttctctgtgctgcgtgtcgatcaactcattccccgtcaccagactcctgtcaaatgtaatgctcattctttcattcctccttttatcatctttactcatatgcgcctcaagcgcactttcccggtgctccgtctattccggaagcaccatgacccatcttccctcttccggataaaaaatcagtttaaactcctgggtcagcccgccgatcaccgctcggcaggcgtattccatggaaggtattccggaataatacttttcttctccaaaacggactgccacatggtttacggtctgcatcatcccatcgtccccttcgaacttaaaggacaggggctggatcgctccggtactggtaaaccacgccttgcacgcgattttgatctgtctgccagccagaagcccgctgtccgctctttccgcatttgtccctattccgaacgccgacatgtcaccactcctttaaaaaacttcctgtctgctgtaatccaccgtgcgcttctcccttgcgattccgccgcccatgtgatcatgtacggcggctccctccggatgctccgggagaaaggctgcgcgttttacagcatcgttgccgaaccgcctccggatttcatcgactgccttatccattctctccagcttttcgtaatccatgcggtcgaagagcccaatctgcctggattcctctgaggaaacgtgacttgtatggatgcccagatggcggaccggcgtcttatcccacgcctcgtcaaatgcccggcacgccgcctcatacagttccctcgtgatgttggtcggcgtttccagcgaaatctgatgagaatggtattcgaacagataatcccggattcccaccgccaccacaccgattttaacaccgtccttcctgagtctggcgcccagcgtttccgccagggacaagaggaccagttttgccgtttccgcgtcacagacgtcaaaggccaccgtggtggaattgccgtatcccttattgggcggagcttccgcctccactgcagatagatcgacgccgttggcaaagccccagatcacctctccctgttttcccaggtgacgccttaaaatatccggatcgctctgtgccagctccccgatcgtggtgattccgatccccttgagcttccggtaggtcgcgcgcccgatgaagaaaagctccgatacgggaagcggccacatcttcaccggaatctgctccttccacagcgtatggacccggttcggtttcttaaaatcagaggccatctttgccagaagcttattctgcgccacgccgatgttcaccgtaaaccccagttcctgtaagattctctcccttatcgtctccgcggccgcctccggcggtccaaacagcgccgtgctctccgtcatatccatataagcctcgtcgatactgtactgttccaccagcggcgtatactcctttaagagacggatcagcgcatcactagatctctgatagagattatagttaggcggaaccaataccagctccggacactttttcaaagcagaaaacacagtctctcccgtcttgatcccgcatgccctggcaggaatggactttgccagaataatcccgtgacgcctcgtcacatcgcctcccaccgcagagcaaaccgtcctcaaatccaggcggccgcccaaatgcttcatccggtagaccgcttcccaggaaagaaacgccgaattcacatccacatgaaatatggtgcgttccatcaatcatcacctcaatactattgtatcgaatatatgttcgattgtaaatggaaagtaaaggaagctgtcacagcttcccctaccgtcgttctattcctttaaagcgcctttttcatcggtttttaaatgcagctccccttcgaacatggcgccgtctttctttgcccggtaaagctctcccttccagatgatccactggtctctggccatggcgccgtcggtctttaagtaataccagatcccgtcagagccggtcttccaggtatcgtgcaccatcatgcccgcgccgtcaaaccagtaccactgatcgccgtccttgtaccagtcatcggccacatagcttcccgaatctccgagatagaaccgccacccgccgtcctcctccagccatccggatttcttttcctgcacggtgattccgtaatacagggcgatggcatcggcttccgccctggccagacggtccagattcgattcctttaagagccatgcggctatctgcgcgttggtatgaaaggagtgctccaggatgagccctggagtccctacggaggccgcaccccggagcacaccgtaataatccccgttctgtcctcttctgtgctcaattctggcaggctgtttcgtcttcatcaccttttccacacactgcgcgagggccattccgatcccatccgcgcttccgttaatgacgcagtaggcggccggatagtccacctgattgttcacactggttcccaccgcgttggaatggtcggacaggaacaaatcgcatcctttcgactccgcacctctggcgaaaagacccttgtcctcatcctcccggcgcctcgtggtgatcacttcgattccatactcttccaaatactttttctgcagaaggtgcagtttccataccatgacagactcgtaataccgatggtctgccgggctctggttataccggccctgatggcccgcatccaaacatatcttcatatcgctgctgactcctttttaagcttatactacaggatatgaaactttgggacaggtgttgcatcaggctcccgcgcccataattttgtgtgataacgaaaaaagcttccggatttattttccgaaagcttttttatgacctatccgagaatcgaactcgggtttccgccgtgagagggcggcgtcttgaccgcttgaccaataggccacgtatcgaatgttaaccaaaaatcgtcgaggcgacaagattcgaacttgcgacctctgcgtcccgaacgcagcgctctaccaaactgagccacgcctcgatacctttggtagtataatataaaaatgatggattgtcaactatattttggaatttttttaattttttaaaatataagaaaaattctactgctgttccaccgccgtaaagcccagatcatcgagaatttccactgcttttccgtagtccttctcttcctcgatcaccacggtcttggtctctaaatccactttgtggccgattccctcgtgatccagccctttgttgattcttgatacacatccgttacacatcatttcatcacagcgataagtcttcatagtctttatctccttttctttttcataaattgcagtttgtcaatcacttcataaccttctgtatcgtcatacacagctcatcgaccgcttctaaattgccatcctgaatctgttccacaacacagctcttgatatggctcgacagcagcaccttattgaagctgttaagtgccgcctgaaccgcggatacctgtgttaaaatgtccacacagtaccgctcgtcttctaccatgctcttgatgccgcggatctggccttcaatccggtttaagcggttcagtaagtccttttcctccgcggcctgacgatgcttgtgcttcaccgcacagtcacatgtgcgttccaccatatcatacctccattccttatgccctacagctttactgtctttaagcgaagcgcgttgctcaccacacagaccgaactcaatgacatggcaaatccggcaaacatcggatttaacagcgggcctccaaataagtatagcacacctgcggccacagggatacccagactgttatagaaaaatgcccagaataaattctgtttgatgttccgaatcgtgagacggcttaattttaccgccttatagacgtcgcgcagatcggatttcatgagaacgatatcgccggattccaaagcgatgtcgcttcctgaaccgatggccgttcccatgtccgcggatacaagcgccggagcgtcgttgattccgtctccaaccatcatgacagtctttccctgcttctgcaaagactccaccacgttggccttgtcttccggcagaacctctgcgattacagtgtcgatatgggcctgcttaccgatgtagtccgctgtcttctgattgtctcccgtcagcatacacaccgtgattcccagactctttaactggtccacagcctccacgctggtctccttaatggtatcggctacacagataatgccctttaacgtgccatccaccatcagatacatcggtgtctttccctggttcgccatctggtgggcctgctctctcacgggatcacccatggataccttcatctgctccaccagtctttcattacccacggccacctggctcgttccgatggatgcgatgattcccgctcccgtcacgctctcaaacttctcaggcatggcaagctccagcccctgttctctggccttcagtacgatggcctgccccagcggatgctccgacatctgttcacagccggccgccagcttaagaagaccgtcggaggtctccgtctgatccagaaccacgatgtccgtgaccttcggcttcccttccgtaatcgtacccgtcttatcaaatacgacagtgtctaccttatgagcggtctccagcgcctcaccgctcttgatcaggattccatggctggctcccagaccggttccgaccatgatcgccgtcggtgtcgccagtcccagcgcacacgggcaggcgataaccagaaccgccacaaagatggtcaggacaaaagacagctccttgccgccaaacagccaccagaggagcgccgcaaccagtgcgatccccataaccgtcggaacgaagtatcccgcaaccttgtctgccagtttggagataggcgcctttttcccctgcgcgtcctcgatcatcttaatgattttggaaagcgtggtatccccgcctgtatgggtaacctccatctccatggccccattgtaattcatgctgccgccgatcagggtgtcgccctcctgcttctccacagggatgctctctcctgtcagcatggactcatccacgctgctgctgccgcccgccacaataccgtccaggggtatcctgctgcccggcttgataaggacatgctgtcccactctcacactggccgtctccacttcccgttccgtaccatcttcatagagaatcgcggtatccggggccagctccatcagctttctgatcgcctcagaggtcttgcccttgcttctgctctccatgtatttgcccagcataacgagagtgacgaccacggccgccgactcgtaatagaggtgatgggcgttcatcggattcaccggtatcgtaaccgtcatacagaggctgtagataaacgcactgccggtgccgatcgccaccagggaatccatgttcggattgcccttaaacagcgcccttaaacctaccagataaaacttccttcccgcaataagcaccggaaccgtaagaatcagctgtgccagagcatagttgaaaggattggcttccatatggaggaaatgcggaagcggaagttcaaacgggagcatatggcccatggaaatgtacagaagcggaaccgcaaaacagatggccacgatcagccgtctcttcatcgtgtcgcgctgctgctcctgcttcccccagttttcctcctcctgggcctttacatctttctcctccgccagagggcaggcgccgaatccggccttctccaccttccccataatcatctccggagtgactttcgtctcgtcgtaggtgatggtcatcttgttcgtcgtcagattcacgtcactcgactccacaccttccagttttctcgtgacccgttccaccgcactgctgcaggctgcacaggacatgccttcaatatcgtaaacttcagttctcataagatcatcctttctcatatacccctatagggtatattcattatagtatgatttcttatccctgtcaatggtatctgtcaatattatttctcaataaagaaaaatcttgctggaaatcttcggaaataaaaaagcagattccgcggcgcttcttgaagaagccgcaggttcatggtagaattagacagtcttgtttcagcaaaagctttacaaaacaaacaaatgagaaagcaggtattgattatgtgggcaaatccgttaaatccgggagataccatcggcattatttcccccagccataccgtcactccggacgactacgcgaaaatcatctccgggatcgaagcgaaaggctttcgggtgaaaacggggagccgcttataccggcatacgtacggctacgcggcaagcgagacagagcgcgccgatgatctcaatgaaatggtttccgataaagacgtcaaactggttttattcggcggcgggtacggcagtattgaactgctgccctatatcgactatgaagcaatcaggaggcatccaaagctgttttccagtcacagcgacggtacctctattctcaatgcgatttacacgaaaacaggcctggtcacgtattacggtctgccgcccaggctattcgaggatatcgacgcctacgcctatgaacaattttcctcccatctggttcgccgggatgccgttcatttcgtcagcaacagcacctggtattccctgaaagacggcatctgcagcggcaccttaatcggcggctataccctgaattttgccctgtctctgcacagcggctatctggaaacagaaaaagaccggaagtatatcctgtttctggaggatcacgagaaatttagttccgtcgctgcagtgagcatgtatctgtcccatattgagcagagttccttcataaatcaggtatcagggctgctgttcggcaactattcagacaccttatcgcagcagctgcttggcaggctggaacgtttcggccggaaacacagcatcccggtcgcgtactgcgatgatttcggccacggaaaaaatcacgccatcctgccagttggctgccgcgctgtgctggatacgaaaaataagacactgcggtttctcccttcataattggcagcaaaaaggcaggtctgcacaggacctgcctttttgctgtattgccaaatcagattatttatttctttctttcaatccgtattctgaatccagaatacaaaacccagaatgacataatagctatgctgccattaaaattttaaaaatcaaacagtgacagctgattagactccggcagttcgcccagcagtcctaaatctcccatcagatcgcacaccgtcttactgaccttcgtcctgttccggaaatcttcctttgataagaacctgccgtccttcacggcatcaaccacggcatcagccgctttttcaccaagtccgtcaatactgcttaaagaaggcatcagcttgcctccgatgatctggaaatggcgggccttcgcctgatagatatcgatcggcgtaaagtcatagcctctcgcgtacatctcctgaacgattctcatatcgcggagcgtatcctgttccttctttgacaacgtatccatccgcttcctgtagtcagccaggtaatattccagcttatcgcgtccctggcacatcagctcataggagaagccattggcgcggatactgaagaatgctgcataatacgccagcggataaaacaccttacagtaagcgatacgccacgccatcataacgtaggcggccgcatgggccttcgggaacatgtatttgatcttcttacaggaccagatataccagtccggcacgccgtggctggtcatctcctcttcccactccggctttaagccttttccctttcggacactctccatgatggtaaaggagagtccctcctccagccccatggaaatgagatagatcatgatgtcgtcacgggtacaaatggcggtctgaatcgtcgcctttccctcctgaatcaaggtctgggcatttcccagccatacgtcggtaccgtgagccagaccggcgattcgcacaaggtcagaaaaatacttgggctgggtatcaataagcatctgcatggcgaagtccgtaccgaactccggcacgcccagcgctcccagcttacatccgccgatatcatccggcgtaatccccagagccgatgtatcctggaataaggacatgacctccctgctgtccagcggaatatccttaaccggatcaaaaccgattaaatcctgaagcattcttatcatggtcggatcatcgtgcccgagtatatcgagcttcagcaggttatgatcgatggaatggtaatcaaaatgggtggtgaccgtcatggtcgtcatatcgttggccggcctctgcactggagtaaaggaatagatctcctccccgtgaggaagcacgatgataccgccgggatgctgtcccgtggttcttcttaccccgacgcatccctggacaatacggttaatctcacagtttcgtttatgtacgccgtgttcctcatagtaattcttcacatagccgtaagccgtcttatccgccagtgtaccgatagttcccgcacggaaggtctggccttttccgaagataacctccgtatagtcatgagccttactctggtactcgccggagaagttcaagtcgatatcaggctccttgtctcccttgaatcccaggaatgtctcaaaggggatgtcgaagccatcctttgtgagcggatggccgcagaccggacactccttatcctgcatatcacatccggccataccggaatacttcttcacttcctccgaatcaaaatcgtaataatggcagttggtacaataataatgcggactcagggagttaacctccgtgataccggacatgtacgcgacaaaggacgatcctaccgaaccacgggaacctacgagatacccgtcctcgttggacttccacaccagtttctgcgcaatgatgtacataacggcgaaaccgttggaaatgatggagttcaactccctctccagacgctccgtaacgatcgtcggcaggttgtcaccgtagatcacgtgagccctgtcgtaacagatctgcctcaaatccccgtctgagttttcgatgaccggcggacatttatcggggcgcaccggcgagattcgctcgcacatgtccgcgatcttccgcgtattctttatgacgacctcttctgccttgtttggtcccagatactcgaattccttcagcatctcctccgttgtccgaaggtaaagcggcgcctggtcatcactgtccttaaatccctgtcctgccatgatgatccggcggtatacctcgtcctcgggatccaggaaatgaacgtcgcaggtggcgcagaccggttttccgaactggtctcccagttgcacaattttcttgttgatgtcgattaaatcctgctccgaatttatgctgctcttttcatcacggagcatgaagctgttgtttccaagaggctggatctccagataatcatagaaccggaccagcctggcgatctctgcgttggagccgccgcgaagcagggcctgatacagttcccccgcctcacaggccgatcccacgattaagccctcccggttctggttcagcagactcttgggtattctgggccttcgggcatagtagtcgatgtgggaccatgagatcagcttatagagattcacacgcccgatatcgttggttgcgataatgattacgtgataggtcggaagcttcttgatcatctccggagtcatcgtctttaagctgtttaactcgatcagcgtctccacgccgcgctcccgcagcatctggacgaatctgacaaagatctccgccgtacatcctgcgtcatccacggcgcggtggtggtttgccagcgagatattcagcgccttggcgaccgtgtccagcttgaatctgtttaggttcggcagaaggaaccgcgccagagtcaccgtatccaaaaccgtaggttcaaagggaagcccctgcagctccgcgtttcggttgataaagctcacgtcgaaggaggcattgtgagccaccagaacagatccctgacagaattccagaaactgcggcagaattacatcaatcttcggatatgggagcaccatgttgtcattgatgctggtcagctgctcaatctcgaagggaatcggtacatccggatttacgaaggtgctgaatttgtccgtaatgactccattcaccaccttgacggcgccgatctctatgatccggttcttttccgggctgaagcctgtggtctcgatatcgaataccacgaaggagtccgcaaatgtctggtctttcggattatccaccagcagcttcaagtcgtcgacaagatacccctccaccccatagaggatcttgaaggtgtcccccttgtccagagcgtggttggcatccgggaaggactgcacgcatccgtggtctgtgacggcgatggccggcataccccacttttttgcacgctttacgatatcctttacctccgaaacgccgtccatatcgctcatcttcgtatgacagtgaagctcgacccgtttttccaggcttccgtccacccgttttccggtgaagtcctctgacttcttgatgcctgccacagagcccagagtcagctcgccgtcgaacttgtcgatggtcgtcacccccttaatcttaataaacgtccccgccacaacggcagccttcagatcatccagctgttcctcccttgcgaacatcttcacggtaatcgtatccgtaaagtcagagacatcgaaaatcataatcgtctttccgctccgcagttcccggctgtccaccatgagaatctttccgcggatggttacctctccgatctccccgtcgatcttttcgatctccatcgtctctccatcgaaatcacggccatagagcacgtccggattatctgaacgttttcctccgtagccaccataaccgccgtttttcttataatccttatattctttcttctggtccttctttccgtaatccccgttcctgtcttttttattttcgtccttcttattctcgtccttcttaccgcccatacgcagaaccggagcgcctgccccgctttccgccgctccctgccgggccgggccctcgtcgaagggaacttccgcggaatatcctgccgccagtgcctccagagatgcaccatccgccatggaaggaccgccgtatccgtcctctgtcccagttttcgacagcatctgctcctcgtttaagacagcggccagagaggtcctgctgacgatctcctccacctcgcgctgcatctgaagctccttctgcttcgccagcgcattctccttcggctccacgtactcgtagcgcacctcaacagggaggccgcagcgctcataaaaaatcttctccagaacgcgctttaactcggcttccttttcatgggtgacaatggtgtcttccaccgtcatcttaagcagatccggctccggaaattcatattctgtcttccggaaaatattatattcgatgatactgtagtttttgagttccatcaggatgctgtcccggtacacatccagtagcttctccggcgtgtactggtcagacaggcggaacttctcgataatctttattgatacctgcttagaggggaagagctggtccttaatgcccttctccagcccatagatattctgtttatggatcagtctggggctcacgatataaacgcgaatagagcttctatccctggtggaagtgaccttctcaacttccaccagatttaaaagctcccgcagttcgtctgtcatattcagatttggaaatacatccaaaaatgcttttgtcattccatcacctgttgctttctgccaaacattatctcctcttatcctggagcgtgtctgaaaattcatttccgccatctgcacatcacacttcgcggcatatttgatcccaattcagtcagcgtagcccactacgcctccttcatcgggaccaaatctcccacaaagtgtaatgcacagctgacagaaagcaattttcagatacgctccagctttaagagctcctctctcaaagcgtcaagtaagttctcctcgggtactttacggataatctctcccttgcggaataaaaggccctcgccgatacctccggccacgcccagatccgcttccttcgcctcacccggcccgttgacgacgcagcccataacggctaccttgacatcgagatggtcaaattccgtcaccatggcttccacccggttcgccagggaaatgagatcgattctggtccgtccgcaggtcggacaggagacaacctccactccgccctttcgtaagcccagggtctttaatatctgcttcgccgtcgtcacctcttccaccggatctccggttaaggagacacggatcgtgtcgccaataccctgatgcaggataattcccagcccgatggaggacttgatcgtccccgaacgcacggttcccgcctcggtaatccccacatgaagtggataagcggtctgctttgcgatcagttcatgagcctttatgcacatcagtacatcggaggacttgatgctgatcaccagattatcatatcccatctcctcgatcatgcgcaccttcataagggcgctctccacgatgccctctgccgtcactccgtgatacttttccagtaattccttctcaagcgaaccgctgttgacaccgacccggatggggacgccgaattccttcgccttatccacaacggccctgacccggtcctcactcccgatattgccgggattaatccggatcttatccgcgccgttctcaatggaggccacggccagccggtaatcgaaatgaatatccgccaccagcggaatatgaatctgtctcttgatctcctttaaagcctctgccgcttccatcgtcggtaccgccacacggataatatcacagccggcagcctccagcgccagaatctgggccaccgtggcagccacatcctctgtctttgtattgcacatggactggatcagaatgggatttccgcccccaatcttccggttcccgatagaaaccgtcttcgtctgttctctgtccgtcatcgcactttcctccatttgcacactcccgggaaccccttcccatctctgtgggggaattccgggatatacacagtatttttcttgtttttcatgcccactttaggtaaagcggctgatatcgttaaatacaacgaacaccatcagggccatgagcgccatcataccgatcagattcaccatgccttctttttccgggtccatgcgtttgccccggaccgcctcgatgattaagaacagcagtcttccgccgtcaagcgccggaatcggaagaaggttcataatccccaggttcgcactcaaaagaatgcacatactgaggacattcataatggccgccatgacgctcactgtcagccctgccttcacggaatcatcgatcataaccacgattcccaccggaccgctcaagtcattgacactggcttttcccgtcaaaagcataccgagactcttaatcgtcacggtaatatcatatttcacctcataggctccgtatttcaccagttccaggaaagacgctgcccggacatttaccggagttacggaaatgcctatcatatactggttgtattcttcattaaattccggtgtcaccagaaccgtaccgcgctcttttctgcccgtctgcgcatcggttctctcataggacacccggctcatcttctcatccggttttaacatgcggtaaaggatataatcgccgtaaaccgtcatcttctcatcgtttacaccggtgattacatcgcccggcttaagccccgcctcgtaagcaggagaaccctctgtgacttctttgatctgagtgatattgtatccgcccattcccacgagaatcagtgccaggaaaaaggcaagaataaagttaaagaccggaccggccgcgataaccgccatcctgcccgggatgcttgcattctgaaatgctccttccgccggattttcctcgtcttctccgagcatcatacaggagccgccgatcggcagcagctttaaggagtacgtcgtctccccttttttgacatggaacagcctcggtcccataccaatggaaaattccacaacggcgatgccgtttaattttgcaaataaaaagtgccctaattcatgaatcagcacgatcagtccaaatacaagaactgctacgataacgctggacaatctaccacctgctttctatatagtcataagccgaagcctctgcttccagaatctcatctacagacggattctctttcacagtatgccctttcatagccccctctatcatatccgtgatggtaagataagaaatttctctgtttaaaaattttgcaacggcccgttcattggccgcgttgaatacagtcggcatggttccgccggttcttccggcctcgtacgccagggaaagccccgggaaattgtccatatccggcttttcaaatgtgatctgcccgatgctccagaaatccagccggtccccggccagaaaacggcgctccgggtagtaaagtgcatactggatgggcagcttcatatcaggtgttcccagctgtgcaatcaccgccccatcgtcgaactgtaccatggaatggataacgctctgcggctgaaccacaacctgtacctgatccatggagacatcgaagagccagtgcgcctccatcacctccaggcctttattgaccatggtggaagaatcgatggtaatcttccttcccatcgaccagttgggatgctttaaggcatcctcgatacgcacctttttaagctcctctctcgtctttccgcggaacggcccgcctgacgcggttaagagaatcttatgtaccgcctttttgtcctcgccgttgaggctctgaaaaatagcgctgtgctcactgtccacaggcaggatctttacgcccatttcctttgccagaggcataatgatatggccggccgtcaccagcgtctccttgttggcgagcgcgatgtctttccccgcctccatggccgcaatggtgggccgtattccaatcatgccgacgatggccgttaccacaatctccgcgtccgtctccacggccgccgcgatcagcccatccatgccacataccaccttcaccggcagatcgctgaccgtcagggcaagctccttcgccttctcctcttcccacacacagacaatctccggatgaaactcccggatctgttcttccaaacgtgtaatattacttccagccgccagagcggttacttctatatccttctgagctctcaccacttccagggtctgtgttccgatggaaccggttgaacccagaactgcaatctttttcatgctgtttttcgctccttttatctttctcgcgttcctcttttctcatcgccggaatttgctcatcgcagaaatgttactgcaaagaatatggcaggcgccgtaaacagcatactgtcaaaccggtccagaataccgccgtggcccggaatcagatggccgtaatccttcactgcgtgattgcgttttaccgccgatgccgccagatcgccgatctgtgaaataaccgccgctatggcacaggccaaagcgcaggccacctgcgggttctgtacctccgccatggaagcgccgaacaccgtcgcataaaggaaacccagaagcgcagctcctgctacgccaccgatcgccccctcaatcgatttcttggggctcaaaaccggagccagcttatgtctgccgatcagcatgcccacgcagtacgcgcaggtatcgcatccccaggaactcaaaaagatcagccagacgagatactttccatccgccatgacgcgaacctgatacagataagacagcataaccgccacataaaagacgccgaagaacgctaccgtcacttcctctgtcttatatttggggaacgtaaagacatagatggtcatcagtatcataagaaatgcgatggacattaacatcatatactgctctccatggaaccacaaaagcccgtagtaggacaccacggtcagatagccggcaattccgatcacattcttctgtatcttcataacacgatataattcaaacaaccctatcatggaaatggtcacagtcgtagcaaaaagaatcatccccccgcttcccacagtgacgagggcgatcaggaccaggacaattccactgatcagtctggttgtaaacatcgcgcttcctcccttcggactatttcactcctccaaatcttctatccctactattgtacgcagctatcgcctttttcagttcttctttattgaaatcgggccaatagcagtccgtcacatacagttctgtataggctaactgccataagagatagttggacagccgcagttcaccgctggtacggatcagaagatccgggtccggaatctccgccgtatcgagatacgatgaaaatgccgcttcatccatctggtccggagtaatcttcccgtccgccgcatccttcatgatctttctggctgcacgcacgatctcatcccgtccgccgtaattcacagcgataacaaaggtcaggcccgtattattctcggtctctctctccagccggttaatgccgtcgatgatatcctggtcgaaacggcttctctcaccgatcatccgcacccggacattgttcgccctggcaatctttaagagccgtaccatatagtaacggaacagctgcatcagcgcgcccacctcatcgccggaacgcttccagttctccgtggaaaaaccgtagacagtcagatatttgattccaattctggccgcatcctctaccgtccgttccaccaccacacatccttccttgtggcccatgcttctgggcagtccacgcttcttcgcccagcgtccattgccgtccaaaatgatggcgatatggtcaggaatgaccatattatctatattaatttccattatattctcctttatcattccaggctgccctgaaacataaacaggacaggcactttgaaagccccctcacttgcgtgggttggaaacatgcctgccccggttctttctgttatacagtaagaagttcctttgatttcgcttcgattgctttatcgatcttgccgatcatcttgtcagttaatttctgaatatcgtcctctgcctcagctaagtcgtcctcggaaatctcatccgccttctgctgttttttgaaaaagtcattggcgtcacggcggatattacgaaccgctaccttggctgcctcgccttttttcttgacatccttaaccagttcttttctgcgttcctcggtcagttccgggaaaacgagacggattacgctgccgtcgttggtcggattgatccccagttcagaagtcagaatcgccttttcaatcgcctttaagaggctcttttcccatggctgaatgatgatcatgcgggcttccggaacgttgatgttgcccacctgctgaagcggtgtaggagttccgtagtagtcaaccttgattttatcaagtacatgcgggtttgcacgtcctgcgcggatcgtcatataatcactctccagcacttctaaagtcttattcatcttgtcctcgtaaacctgtaaactctcctgcatattgtcctcctagtttatgcggtcacaatcgtgccgtttattttcccctgcatcgcgttcgcaatgctgtctttttcgttcaggctgaacactgccaatggcatgcggttctccatacacatgatggaggcagtcagatcaatcacgcccagctgcttgtcaatgacctcctgtatggaaatctcatcatacttcttcgcctccggattgatcttcggatcgctgtcgtaaacgccgtcgatggccttcgccaaaaggatgcagtccgcttccatctcgatggcccgaagcgcgattccggtatcggtagaaaaataaggatggccggtaccgcctgcaaaaaagacgaccattcccttttcaaaatacttgtttgctctgtccttggaaaaaagctttgtcatggagccgcactcaaacggtgtcagaatctgagtcgtcatcccggcacaccggaagatctcagaaacatagatacagttcataaccgtggccagcattccgatctgatctgccttggtgcggtcgattgcattgctcgtccttcccctccagaagttgcctccgccgatgacgatgcctacctcgacaccagcatccacggatattaaaacctgccgcgctacttccttcacagtcgcttcatcaaagcctgttttattcggtccggcaagggcttcaccgcttaatttcagtaatacacgtcttgggttcatagctatcattctcctgttattgaagcgttttccgctttggtattgtcatgaatgattatagcatatttccttttggttggaaagagaaagtttttatgaggaaatacgccctgtcatccactgcctcccgcatagtacaaaaagtccggtggcggagcactttcctattacataaaaagtccccggaagaagttctcacctcttccggggaccgttaaaattcttttacgtcagacaattaatccattgtcgcatactggaagaaccagtagccgtatggagaatgccatgttccttttaacttcggatcctgtaaatagaaatcgttgtagtaagcaatcggtgccatagctgcatctgcaagaatcatgttctctgcttcatgcagttttgcataatgctcagcaacgtcagctgtagagttggcatcgtttaacatcttgtcaacctcaggattgctgtacttaccgtcgttgtttccgccgccggaaatcattaagttcagcatgttggaaggatcatcgtagtcatatacccagccgttacgtgcaacctggaaatcaccggcacgacgggttggtgtaaatgtagaccactcaacaaccttgatatccatgttgatgccaagtgcttctttccagcaactctgtaagtactcagccagtggtttgtggtaaccggcatcgttggtcatgtattcaatcgttgggaatcctgctccgtccggatatccggcgttagcaagtaattcttttgcttttgcaatgtcagcgtcatgatcagctacattgaagaagtctccgccgttattcttacgtgttacttcttcgaaggaggaaccatcctctgcatcagaaaggccaggtccaacaaagttggtagctggggaataagttccctgcataacagtgttggcaacgtaatcacggtcgatagcaaggcttaatgccatacgtacgtcaggattgttaaatggttctttttctgtctggaagctgatataatatgtacccattaaaggatctacatggaaatcttcgttgccgcgcaggctcggaacttcttctgtaggaacatccttgatcatggaaacttcgcctgtctggtatgcgctgtaagccgcattggaatcttccatcaggacaaactttaaggtattcactgtaaccttatccgcgttccagtaattttcattctttgcaaaaataatatgggaacctggtacccattcgatcatttttaaaggaccgtttgatacataagtctctggtgttaaagtccactggtcgccgttcgcttcaatcgttgcctgctgaacaggaaccatggaaccatgtgtaatcagttttgagaaatatacacaaggagatgccatctcaacaacgaatgtatcatcatccggtgcggatactccaagtgcatctaaatcaccattagaagcttctttatagccttttacgtagccaagcatatccatcgcatacggtgctgctgtgttcggatctgcaagtctcttccaggaataaacgaagtcattcgctgtaagaggtgttccgtcactccactttaagcctttgcgaagatggaaggtataggtaagtccatcatcagaaacttccatagattccgcctgccctggtacgatcttattctctgagtcaacgctcatcagagtctcaaatgcatgaagaatcatgtttccaccgtctaccgcgctgtttaaagccgggtcaactgtctcgggatcaggtccgatctgaactgcaagatcaaggccagcgcctccgttttcagccggtgcagcagtctcgccctctgcggcagcagctgttgttgtggtatcggcagcttttgttgttggagcatcagcggtcttgttgccgccgcaggcagtaagaatcatgccggatgccataacagcagccaatacaagtgctgtttttttcatatcaattcctcctctaaagaatttattcaaattagcacagcagtactttacctgactactgtgctgatttgtcttttagcataccacaaatctccaggaatagcaacttagaaattaatttactttgtctaagtggtggcatgctgcgtaatgaccagtggaaacttccttccactgcggctcttccgctgcgcagagctcgtctgcatacggacagcgggtacggaaacggcagccgctcggcggattcaccgggctcggcacgtcgccttccagaacaattctcttagattttctgctgatctccggatcagcgatcggaatcgccgagatcaggctcttagtatacggatgcacactgtggaatgtcagctcatagctgtctgccagctccaccagcttgcccagatacataactccgattcggtttgatatatgttttacaatggataaatcatgtgcaatgaaaagataggtcagtcccagctcttcctgaagctgctcgaacatgttgacaacctgggcctggatggatacatccagtgcggatacaggctcatcacacacgataaactccgggtttaccgccagggcgcgcgcaatgccgacacgctgacgctgtccgcctgagaactcgtgaggataacggttcgcatgctcggagtttaagccaacggtggaaagcacggataagattctctcgtgacggtccttcctgttggcagccagacgatggatgtcgatggcctcgccgacgatatcttcgaccgtcatacgcggatcaaggctcgcgtacggatcctggaatacgatctgcatcttacggcggtaaggaagcatattcacatgcgtgatatccttgccgtcatagagaatcgttccatccgtcggttcatataatcgaagcagagtacggccggttgtcgtctttccacagccggactcgcctaccaggccaagtgtctctcctcttcggataccgaaggaaacgttatcgaccgcctttacaaccttcttttcaaaaagcttacttcctgcaaccgggaaatactgctgtaagtgttttacttctaccagatacttgtcttccatcatgcatctcccttctgtgtcctggaatcctgctgtttgtcaaactctctcttctgcatcagccagcatgcactgtaatggatatcggataaatctgtatacggcggcatctctcttaaacagatcttcatgcaggcgcggcaccgcggcgcaaacggacatcccgcaggcggattcagcatatcgacagggcttccctcgataggtaccagcttattatgctctttttccgtcagcttcggaatactccggatcagtccctttgtgtactcgtgggacggacggtagaagatatcatctgtcgtaccgtattctacaaccttgccggcatacataacggcgattctgtcacacatgttggcaacaacacctaagtcatgggtaatcatgataatcgccatacccagtttttcctttaagtccatcataagctcgagaatctgggcctggatggtaacgtccagagccgtggtcggctcatctgcaatcaaaagcttcggttcgcaggcaagggcgatggcaatcatcacacgctggcgcataccgccggacaactcgtgaggatactgtttcagacgcttctccggctcgttgattccaacgagagtcagaagttccttcgctctctcattcgcctgctgtttattcttatccgtatgaagcataattacctcacggatctggtttccgatggaataaaccggattcaagctggtcatcgggtcctggaaaataatggaaatctcatttccacgcacttttctcagttccttttctgacatcttttcgatctcatgaccgttgaattccagggaaccgccgatcagacggcccggatatgcggtaattcccattaaactgtatgcagttacggatttaccggaaccggattcgccgacaattcccagcacttcgccttcttttaaatgaagagacacatcatttaatgcctttacttcacccgcgggagtaaagaaagaaaggcgttcatttttgatatttaccaaatactcgctcatcgtatctctcctcctttagtctttgagtttcgggtcaaacgcgtcacgcagaccgtcgcccagtaagttaaagcttaaaataatgacggaaatcgcaagcgcaggtgcaaacagacggtgcggataagactgcagaccatttaacgcagcactggcaaggcttcccagagaaggcatcggcgcagcaacgccaagacctaagaagcttaagaagctttccgtaaagatcgaggacggaatctgcagcgttgtggtaacaatcagagtaccgatacagtttgtcagtaagtgcttcttaatgatacggccattggaagcacccagtgccctggccgcggtcacgtattcctgttccttcagaataaggatctggcttcgaacgattcgggccataccaacccagtaaagaagggcgaacacgacgaaaatactgatcaggttgacaccgattacctgaatccattcaaatcccggtttttgagccaacgcctttaggggctggtcaaatgcaaccgataagagaacgatgatcaggatatcggggaccgtatagatcatatcgacgatacgcatcatgatcatatcgacccagccgccgaagaagcccgcgacggaaccgtaaagggaaccgatcaacaggatgatggcggaggccacaagacctacggtaagggagacacggctgcccatcatgacacggactgcataatcacgtcccaggttatccgttcccagtacatgcgggaatacgctctctcccgccgcctttgcctccagttccttttccgaatactgcatgggtgccagattctcgcttccgcgaatctgctgctcatagctgtatgggtagagctgcggtaccaggaatgaaaaaatgaatacaaaaacaataactaccaggctgaccatggcaatcttattcttctttaaacggcgtattccatcctgccagaagccaacgctcttgcggaggacggtaagactctctttttcctcgtcacttgccgggagaaagtcgtctacgttaagctgtaatgataatttattattcgacatcttctttctcctttctatttaagattaatacgtggatcgatgaatttgtaggcaacgtctacgatcacgttcataacaaccatcaatgaggcaaggaatatggtagttcccatgatcagcggataatcacgtcctgtgatggaaccgataaactcggagccaaggcccggaattgtgaaaattttctcgacaataaagcttcccgttaccgtataggcaagaagcggtcccaaatacgtaacaaccggaagaatcgcgttacgaagcgcatgtttgaaaatgctgattatctgagaaagtccctttgcgcgtgctgttctcatgtagtcctggcccataacatccagcatggaagaacgcatcagacgtgcgatataggacgacggatacagtgccagcgcaataaccggcatgatgtagtttttccacgatgccagtccgtacgtgggcagcagccccagcttcagactcaggacatacatcaggatcgtacagattacgaaactgggaatcgcaattccgcacgtactgaatacgattatgatgtcatccaccaccgtccctcgtttaaaggcggcaatactccccagtggaacgcccaccagaactgccgttaagattgcgatgccgccgactcttgcggacaccgggaacttcgatgcgatgatcatattcacggtacggccgcgctgttttacgcttaaaccgagatttccgtgaagaagatctttcatatatgtaacatactgctcacttagaggcttatcaagaccgtatttctcattcaatgcggcctgtgcctgcggacttatggccttctctgacatgaaagggccgccgggtaccatgttcataacgaagaatgtaacagatgcaaccgcaaatattgttacaatcgccatgatgatacgtttaaaaatatatttagccattgtgtcaactcctttggtataaggtttccttcgcgcagcccggacggaagcttgcaggcttccgtccctgcgttctgcgaaatatcaatagtctctcctgctctgaacctgggaaaagggcgaaatgtccgtctaatctggaaacatctgtcaacgctaaacggacactgtctctatagaaaaatcccatggatgcccatgggattcccccctgaatcctctttccttggaaagtcctcctcgtttatgcgcggcggaattttgtaagtccccctcacatacgttcggcggaatctattactgcatctgttttgcaacttcagcagcaaaatcttcttcttttttctcaagaccttcgccggtttcaaaacgaacgaatttcttcagttcgatctttccgccaacttctttggaaacctgctctaagtatttagcaacagttaaatcgccatctttcacgtaagcctggtctaacagacagaattcttttaattccttgttgagacggccaacgatcatcttctcgatgatagcgtccggcttatccggattctcgttcttagcctgaacctttaaaatctcagtttcatgctcaacgaattcctgaggaatctcgtctctctttacatactttggtgttaaagctgcaatctgcattgcaatattctttaaagcctcttttacatcatcgttgacaacttccgcagaagcttccagtaatacgccgattcttccgccgccgtggatatagtcgattacaacaccgtctgtggtgatcttctcgaatcttctgatgttcatgttctcgccgattactgcgatctggctggataattcctgagctacagtcagggaagcatcctttgcccatgcttccgccatgaatgcatccatatcctgcgcgctgcttgccagtacctgcgctgccacatcggcaacatagccctggaactgcgcgttctttgctacgaagtctgtctcactgtttacttcaacgattgctgcagactttccatcttcgcttacaagggtcttaacaagaccttctgctgcgattcttcccgccttcttggatgcagctgcaagtcctttttctcttaaaaattctacagccttttccatatctccatcggttgccgcaagtgctttcttacaatccatcatgcctgcaccggtcatttctcttaactcttttaccattccagccgtaattgctgccatttgatttccctccatgttcttttcgttattcatattatacaggtttaagcttcctggtctatagggaacttcttccttttcacccgcagcagtctctgccgcagcgcggatcccgctgccccataaatcgaaaaatgcttcaacccgcttatcacagccggtcgaagcattcatctgcctgaacaattaagcctctgcagccgcttccatttcctgagctgcttctgcttcttcagctgttgcctcgccctggtttgcctcgattactgcatccgccatcttggatacgatcagcttaacggctctgattgcatcgtcattacccggaatcacgaaatcgagttcttccggatcacagttcgtatcagcaatgccaattaacggaattcccagtgtatgagcttcctgaatgcagattctctctttcttaggatctacaacaaagatagcatccggaatcttcttcatttctttaattccgccgaggtttctctccagtttctcccattctttcctgagagcaataacttccttcttaggaagaacgtcaaatgttccgtcttcggacatggtctcgatctgttttaatcttgcaattctggactggattgtcttgaagtttgtaagcataccgcccagccatctctcatttacaaagaacataccgcagcgctctgcttctgccttgattgcgtcctgagcctgcttcttggttcctacgaaaaggatcttaccgccttctgcagcgatatcggctacggctttgtaagcctcgtctacttttacgacagacttctgtaagtcgatgatgtagatgccgtttctttctgtgtagatgtacggagccatcttagggttccatcttcttgtctggtgaccgaaatgtacaccagcctctaacagctgtttcattgaaataacactcatgttattacctccatttggtttttcttccgtctgcttctcttgcttccaaggagaccattagttggcaccttcctccagaatctgcaaacgtgatttttagtaagcttagctagtatagcatatctttaaatcctctgcaagtcattttttacttttaatgacaatttttttcatactttcgtaaaaaaaagaagcagtttttcttcgctgcttctttttgccgccgtcctgatttacggttcttttatctctctatgtccctgcatcgacttgccgttgccggccttgatcaccttcagttcatcgaagaccacatcgtttaagactttgatgtaggttcccttcataccggaagaacgggactcgataacgcctgcactctcaaactttctgagagcgttgacgattacagaacgggtaattcccacgcggtcagcgatcttgctggctaccaggattccctcatttccatcaagttcgtcgaaaatatgagtgattgcctccagctctgaaaaggataaggtgctgatcgcggattttacgatctgaacctttctcgtctcctctgcattctcctcatttacggaccgcatcatctcaaggcctacgaccgtcgttccgtattcgctcagaatgatatcgtcaatatcgtactgagcatctgacttgtagatgaacagcgttcccagacgctcacccgcaatatcgataggagtgataatggcctggtacttgcggatattgtcgcctgtaaatccgagagtctcgagattcacattctccttggtggaaagaataccgagcagacgttcattcagcataccgtccacgtagccgccgacctgatctgcaatcagttcctgtatctcttctacatcagagctgatcgcaacacccagtaccttcccctttttactgatcacgagaatattagaatttaatatctcgctgagcacttcacagatatcgttaaatactactttgtgcgagttgttgttatgcaataacttgttaattttcctagttttgtccaacaattgaacactcataaccgaaaacctccttaagaatttgtaggaaagctcaaaatacccctttaatatttaaatattaacactattccaacaaaataacaatcattttttgaagattttcgattttcttaataattattctattttgtatttttgctcgtactgtaaccacactgttcgttagagcagagcagtttattgcctttttcgaccatataagcgccacatttcggacatttctctgtggaaggtctctgccaggacatgaaatcacactccggattggcttcgcatccgtaataaattctgcccttcttcgtcttcttgatgacgacgtcctttccgcacttgggacacggtacgccgatcttctccagatacggctttgtattcttgcattccggaaatcctggacacgccaggaacttaccgtgagggccgtattttattaccatgttccggccgcagagctcacagatctcctctgtcacctcatccgcgatggtcacggactccagttccacctctgccttgtccacagcttcctttaaatccggatagaagttgcgcaccacggtcttccacggaacggaaccgtcccccaccttatccagaaggaactccagattagcggtaaaggtgatatcgacaatgctgggaaagctctgcttcatcatgctgttgacaacttcccccagttctgttacataaagatttttattttcctttgccacatagcgtctggcaatgattgtcgtgatcgtcggcgcgtacgtacttggacggccgattccctgttcttccatggactttaccagagatgcctcggtaaaatgtgccggtggctgggtaaagtgctggctgctgtccagcttctcaagagttaaaacgcttcccttctccagctttccaagaagggcgttgctctcttccttctcgtcctcctgaatgtaaacagacatgaatccgtcgaaagccagttttgaagctgctaatgtaaagtagtaatctcctgccgcaaccttgacggatgtcgtctcatagacagccgactgcatacggctcgccgcaaagcgtttccagatcagctggtacaggcggaataaatcacgctgaagcgattccttaacgattaccggtgtcaggctgatatcggtgggacggatcgcctcgtgtgcatcctggattttggctccgctcttcttcgcctgttctccgctggccacgtatttgcttccgtactgcgcttcaataaacgctctcgccgctgtatcggcctcctctgcgattctggtagaatcggtacgcaggtaagtaataagaccgacggttccgtgtcccttcacctccacgccttcatagagctgctgggccagacgcatcgtcttctgtgtagagaagtttaagaccttggaagcctcctgctgaagcgtactggtcgtaaacggaatcggcgccttcttgatccgctccccgttcttcacctcatccaccacgtagtcgctgccttccagatcctttaatatcccatccagctcttctttattgcggatcgtgatctttccttctttattgccatagaacttggcggccagggccttcttgcttccctgctgttttaaatccgcctcaaggttccagtactcttccggaataaaggcgttaatctcctcttccctgtcacagatcatgcgaagcgccaccgactgaacacggcctgcacttaagccacgctttacctttgcccagagaatcgggctgatcatatatccaaccatacggtccaggattcttctcgtctgctgcgcgtccacgagatccatgtcgatctccctcggcgccttcaaggatgccttcaccgcgtttttcgtaatctcattgaagctgatcctgtatacctgcttatccttctgttcatccagctttaaagccttcaccagatgccaggaaatcgcttctccctcacggtcagggtcagttgcgagataaatcttatctgcttttttcacttccttgcgaagcttcgcaagaatatcaccttttccccggatcgtaatatactttggttcaaaatcctgttccgggctgattcccagctgactcttaggcaagtctcttacatgaccgtttgaagcatcaacctcatagctcgttcccaaaaattttttaatcgttttcaccttcgcgggtgactccacaataactaaacaattcgccatacaaaactcctcgcctataatctcttaccataatattgatgggatgtctgaaccacataaccgcccagttccagatccagaagtgtgccgatacattcactcacagacagtccgcttaagatcacaatctcttctaaccccttcggttgcaaatcgaggcaactatacaccattttttcttttttggcaagcccgttctcatttttttcatgaactcttaatattttaccttccctcagagtgaaatattccagcacatcctccggacttaaaagaacgcctgcgccctcctgaatcagccggttgcagccctcgctcagcggatctgagatccgtcccggaagcgcaaaaatttcttttccctgttccagtccaattcctgcggtaataagagatccgctcttctgtctggcctccattacaaggatcacatcggagagcccgctgaggatccggttccttatgggaaagtttttctgctgcggctgctcccacggcatccattccgacagaacaccgccctggcggcacatgctttcgtagagtccgtaattctcccgcggataacagatcttgatcccgcaccccaatacgccgaatgtcttcccgccggccttcagcgctcccctatggcctgcgccgtcgatgccataggcaaggccgctgatgatctgcactccggccttcgccagctccgccgccatgtattcagcttcctgctttccgtaattggtgcagtttcttgctccgatcacggcagccgccggccgctcctcatccggaagttcccctctgacgaagagtcccaccggataatcgtgtatcttaagcagccgctttggataattcccatccaaaaacgcaatcaggcggattccctccttttccagttcttccagttcccgttttcgtctgtccagttggcgtttttccgcatcgaacgcggcagcctccttcgccctcagcaatcctgcattttccagattttttccttctatattatatatctcttcaaaacttttatactgtttaaaaagacgcatgccggtaaccgcgccgattccgggcacggatagaaaccagcagagatattgacgttccttatatgatatcatgatgactgcctccccagtatttttcttccaggctgcgaagccctgccgcttccgccagatgttctttttttatatcgccgctgccttccagatccgcgatggttctggccactttcagtatttttccgtatcctctggcactaagccccatgtgttcaaaaatacgctttagaaatacctgttcacgctgacccaggcggcagaaatctccgatctgcgccccgttcatggcactgttaaaatagattccgctgccctcaaaacgctgtctctgaatcacccttgctgcctcgatcctctcccggatggcaccggagggttcccccatccccttatccttcagttcctcatacttcatcggcaccgcctcggcgcagatatcgatcctgtccagcaatggttttgaaattcggttcaaataccgctgtatctgcggctccgtacatgtacaccggctccggtcgggataatagccgcatttacagggattcatagcggcagcgagcataaaatccgcaggaaattcgtaagcgctgtgcaatctggagatcgtaatcttccgttcctccagcggctgtcttaagacctctatgctgtttttctgaaactcgggtaactcatccaggaacagaacgcccctggaagccagagaaatctctccgggtttaggaattcttcctccgccggtcaaagcctgcggactgatggtgtggtgcggactccgaaacggccgcctggacagcagcggctgatcctgatgaagaaggccgcagatgctgtatatcttcgatatctctacattctcctcgtgggacagggatggcatgatggttggaattcgtctcgccaccatagtctttcctgtcccggccggaccgatatagaggatgttatgcatgccggccaccgcgatctccgtggcccgcttgagaagaaactgaccatttacctcagagaaatccacatcgtaagcatctttctccgaaaagcacgctttttcctgtcttatggccggtgacagctggtcaggatcatttaacatacccgccagcgctctgatgtcctccacgccaatgatgtcgatgttcccgatgatctgtccctcgctcacattgggaatcggaagaaaacaccgtttctttcccgcattcccggctgcagccacgatcgacagaattccggaaaccggtttgattcttccatccagccccagttctcccaccaggacgctggtatccagaatcgactggtccaccagtccggtggccgccagaaccgcgactgcgatgggaaggtcaaatccggttccctctttcctgatatccgcaggcgacaggttcaccgtaatctttctggccggaagccggaaaccggaattcttcagagcggtccgaacccggtcctgcgcctccctcaccgctcccgagagataaccaaccatggtaaagccggggagaccttcgctcacatccgcctccaccacgacagggtacccttcgacacctaaaataccaatactatgcactttgctgaacacactttctcccttcctgattttaatttctgtgttttattctgtgttttcattttgtgttttcattctctgttggaaatatgatgcagaaccgcatcgattcatagaacgttcctgaattggaacctgtattaatcatacaggattttagattgcctggcaagcagtttttaaactgcctgccagtctctgtcaaagctcatgatacgtaatccagcttagaatatcatgccagaccgcttctttatctgtctcgttcaacagctcatggcggtcatccgggtagagaatcatctcggtatccgtcatgccgatcttcttatacctgcggaacacgcgtctgacgcctctcccgaattcaccgaccggatcctgtgcccctgacagaataaagagcggcagggatctgggaatccggtcctcctggcggtgcagctttaaatccagcataatattgaagaaatcacagtacgccgaagcggtgaacttaaaattacagaacgggtcaccgcagtactgatccacagattcacagttcttggagagccagtcattgtctgttctggacggcataaaagaacggttgtaattccccaaaaccagctggtgcatccatttgctctgatactcttttccccggatcaggccgatggaggcggcaatcagtttgcctgcgatcacaatcggcatcgcctgatctcccgttcccataatgatcgcacctgccagttcttccccatacagtgtaagataccgtctgaggaaaaaggaccccatgctgtgccccagcatatacagcggacgccccgggtacatgacgcggatgcggctggctgtcctatgtaaatccctgataacgcagacatggccgaccttatcggcaaagtagccataccgcccattctgcaccgttcctccatggccaagatgatcatggccgatcaccgcaattccctgttctgccaggaagcgggcgaatggatcgtaccgaaggatatgctccgtcattccgtgagaaatcaaaagaagctgtctcacctctccgtccggttcccacaaaacggtatgcagtcctgattttccatcgctggaaggaactctgaactctcttcgttttatcatgaaagtgactcctctctgaaacatgaacagaatcattctgtcgtataggagaagtataccataaatgtaaagttcgtgaaagacttcatccggtctttcggactgtaatcagcgctgatcctttaagccctggtcaaattccggcatatacgccctgtacctcagcggcatatgagtcctctggcacaccgggttccaccgctcttttatagtaatactcctccttaatgccttccacagttcccggtattcgtcgtcttctgttgccttatgaagcttttcctcccactctctggaatccagatccataagaaaccacggccgtccggcctgatgaagggcggccttcttccgtttctcgtcgtagataatccagttctccgccggcatgcggtctgcaaaatgaggggcgattaacaccagcacatcattcttcgggccaatccggctgaccagcatgtcctcatccatctggataaaccgcagaaactcagtctccagatgcgcctcgttgtcgagattcctgcacatatcgaatatctggaatacctcgggcagctggaggctctgggtgatgcctgctcccttctggaacccccggatcaggaaacggtagatatgatccgccttctctccgtttcggctcaaggaggccttgtagatggcttcatacgctgcttccgatattctggtccgcaccgatcggatcaccttttccaccttttcctcgtcgggtataacatcaatgtaatcgcagaataattccatggtgctgtattggcccgcggtctccagtctcacattggaatggcccttccggctcatccatgcgtcatacacaccggttaaaatcccttcaaagctatctttacacgtataaaccgtcatatcactcacatactccctgttactactgaataccggtccgccggggccggggccatattaagcttcatatcatcgaacagcgacagctggcggtaggccccctgctggctgatatcccatactgcacggcgctcatccccgactaagtggctggtgatgtaatcctcatccatcctggtcggatacatcatccggccggaacacgtaataaaatacatggctctcttcagtacgacccccatcttctttaaggattcgaagtccagcaggccctgccttctggccgcgatgattcgttttacggatttcactcccattcccggaacccgcaaaagcgtataataatcggcacggttaatctctaccggaaacagttccaaatggcggagcgcccagtcacacttgggatccagaaacacattgaaattcggccggtcctctgtcaaaagctccgatgccttaaagccgtaaaaccgcaggagccagtccgcctgatagagccggtgttcccgcagtagcggcggcccgcccggaagcgccggaaggctggaatcctcgttgaccgggacgaaggcggaatagaaaacccgctttaaatcatagttctggtacagcgcctccgccaccatcatcatctgataatcattttccggcgtcgcgcccacaatcatctgtgtactctgtcccgcaggcacgaaggagggcgtccttttatattccatcagctcgaatttattcgcggttatgccacgctgaatctgtctcatgggagtcagtatcttgcttctgctctttccgggagccagcttttttaagccatccgcggtcggcagttccagatttatgctcattcggtctgccagaaatcctactttttcaattaaaaccgggtcggcccccggaattgcctttacgtggatatagccattaaagcggtatacgtctctcagcttctttaaggtctggtagatcagatccatggtgtaatccgcgctgtataaaataccggagcttaaaaacagcccctcaatataattccgcctgtaaaactccatggtcagcgtgcagacctcatccggtgtaaatgcggtccttaccacgtcattggaacagcggttgatacaatacttgcagtcatagatgcactggttggtgaagagaatcttcaaaagagagatgcatcttccatctcccgcaaagctgtggcagagtccggctgcaaccgtgttgccaagcatccctgccttaccttttctgtcaacgccgctggaggtgcaggccacatcgtatttggcagcgtcggaaagaatctccagtttttcctgtatacttaaatcttcctgaatcagcataggtcacctcgaacatgtgttctttttcttttattttagcatactgtaaagaatatatcaagtattttcgaatatatgttcgggcaataatttaaacaggctcaggagattttgggaaacggcgtcatacagatcatttgtgcgaatcattatttatgtgtaccctatgttcttcttttgtctttattttccaacttcgtatcgctttctatcccgttacacaaaacaaaaaaacggcttcctccggcgcctgaaatccagcgccggagagccgtccacaccgcataagcggttgtattttccattacttcataacatcacagtatttccttttattccgcgtatccttccggattattcttctgccagttccaggaatcacggcacatgtcctttaaatcgcgttccgccttccagcccagctcacgttctgcctttgccggatcggcgtagcactgaggtacatcgcccgctctcctcggcttgaactcgtaaggaacctttaaatcattggcttcctcaaaggcatgaataacgtcgagaacgctgtatccgcagccggttcccaggttgtagatcaatacgccgcccttttcgccttccatcttcttaagcgccttgacgtggccatccgccaaatccacaacgtgaatataatccctgacacacgttccatccgaggtatcgtaatcatttccgaagacaccgagagattccagcttgccgactgcaacctgggtgatatatggaagcagattgttcggaattcccttcgggttctcaccgattcttcccgattcatgagctccgatcggattaaaatagcgcagaagcatgacattccactccggatcggccgtatgtaaatcggtcagaatctgctccagcattccctttgtccggccatatggattggtgatctctcccttcgggcactcttccgtgatcggaacaaatgcaggatcgccatatacggtcgcggaggaactgaatacaatgctttttacgccgtgttcgcgcatgacgtcacagagcacgagtgtaccggtaatattgttgtgatagtattccagcggtttgtaaacagattctcccaccgccttaaggcctgcgaaatggatcaccgcgtcgatcttctgctccttaaaaatacggcttaacgctgctttgtccagcagatcagcctcatagaatgcaagcgtctttcccgtaatctcctgtacacgttccatggattcctcacaggaattacagagattatccactactaccacctcatagcccgcctttaaaagctccacgcaggtgtggcttccgatgtatccggctccgccagtaactaaaattgccattgtcatgtcctccttctaaaattgtctacggttattatagcagtctgaaccggaataacaatgcagatttctttgaaaaacctatagattttttctattttcaaaatgcaaacgtgtgcggctctctcccggccggaagactgccgcccgcggtactgctgtctttatggctcgaagacgcggtctccttccagaatatcattgcagacgtatccctccatctccatatactggaccgtgtagggataatcgtcccctgctctgtttaccagataaaactggatagccggcggatctgtttcctctgtgttccaagttcccgtaatcttcacatggttctcatcgacaggttccggctccgaaaaagtaaagctgccgtcaaatgctccttctatgtgaaatatgacagcgtcatccttttcgtcgggcacgataaatccggccatggattccggtatggcaggcagctctgtttttccttcaaaaaggacggacatatactccttcagctttcccgtcttcacggaaacttccgtctctccctgcgctgctccggtccccgcgatgccgtagagacaccaccacgcaaacgaattatcagccgtattatagaccatccgcttctccgatgcagtccagaccatcccttttaagacggtttcctgcagcttcagagagtccagtgacgtccggctttcagcctccgcggcaccattttcgctgctgccatttacatgattcaccggttctgccgacatctctttgtctgacggagaggtctcttcctgaatgccggatgaggttgtctccgcattcacctcctggctgcttttcgcagaagtcggggccgtctgtcctcctgttgttccattctcctgtgccgcgtgtccggaggcgcagccgcctgacgcaagaacgcacacaagagccgcggctataagggccgtcctgggcctgttcatacctgtcatacatttcctcactcgtattatatagtagtagtgtttaaagaccctctccaaggtctttatgctattcctttcatagtcactctttaccttttctacaggtatggctatgatatttaagatgctgtggattggtgtttcctcgctaccacttgatggtttcagaaagtgtccaaccacagtctctttgtttgattgttaatcagttagataccgcatgacggtttatttagaacgagttcacaactgcgaagagcacctgtggttctaaaacagtatcaattttacttctaaggagaatttctatgatttacattggtattgatgttgcaaaagacaaacatgattgctttatcactaacatcgagggggaagtgcttttcaagccctttaccattcctaacaatttagatggatttaacgaccttttccaaaagatttgctctgtgtctgatgatttttccgaaataaaagtaggactggaagctaccggccactataatttcaatcttctggggtttcttgttgataaaggtcttcccacctttgtcattaatccgttacatacaaatctgtatcgtaaaagtcttagccttagacagacgaaaacggataaggttgatgcccatacaattgctcttatgatgatgtccggagtaaacttacagtcctactcagacacatcttatcacaacgaagaactcaagtcactaacacgataccgttttgataaggtaaaagaacgggcaaagctgaaaacttccatttcacggctcgtaactatccttttcccagagctggaaacgctggttccatccctccatctggtttctgtctatactttgctggctgaatttcctggcgcgtcagccattgcacaggcacaccttacaaggctttctcacctgttggaagtggcctcgcgcggacgctatggcaaagaaaccgccattctgttccgtaatgctgccagacaatccattggcttgaatctgcaagctaaatctttggaattgaaacataccataaaactcatcagggaactggatgacgagattgctgaaatcgaagcttctatcaaatccattgtagatgctatgcactcaccaattctgtctatacctgggatcagctaccggatgggtgcgatgatacttgcagaaatcggtgatttcagccgttttaactcccctgataagatacttgcctatgccggactatccccatccacttaccaatcgggacaactcgacagcagttattcccatatggaaaaacgtggttcccgctacctgcggtatgccttgtttaacgcgacaaaatttgtctgcatatgggatgacacctttgctgcctatcttgccaggaaacgtgcagagggaaagcactataacgtagccatatctcacgctgctaagaaactggtacggattatctaccagttagaaaaatcagggcaaacgtatcatcgagcggcttagcgcctggcatcatatctcctttttgagcaccggaaacgatgctctatttgtcatgcagttttcaaggtactgatttatctgaattgcgcttccgcaattcagataaaaaaattcattttagtcttgacttttaatagttagactttcccagggcgtaaatacgccttgtatcgtacctgaagaacggactactcgtcccattctttccatatctccggccggtatcccacagtcgcctttttcccattccgaaccacgggagtctttataacctggggattcagcagaagcttttcctcccggtcctcaggtgacagatactttaagagagccagcagatccttgtctttgcagttttcgtcgatcagcgcttccacgcctccaaccgcctgctttacattggtaaactctcctttgctcatgcccttttccgccatatcgatcatctgaacgcggatattccgttccttaaaataccgctctgccttcttcgtatcaaaacacttcttttttccgaatatctgtatgttcatccgtcaagcctccaccacaaattttcctctgtcttccacttcttaaagccgcatctgcccagtacacgtatggaggccagtccgtccggctcggtctccgcgatcactgcgcgcacctcttcctgctccagcgcccaccggcacatggctccgaccgcttccgtcatataacccttgtgctcatatttcagtcccaggccgtaaccgatctccacctggccttccggatccggtacgtttttaaaatctgcggatcctacgaccacacggtcttccttgcgcaccaggaaccagaaggtgtggtatacgtaatgcgcctcatccttctcggttatcccgcactgcccttccacaattttcaggaaaataccttccatcggctcagcatcatagacaacaccgagttccgactccagctctgccatatcagtaacccaaagccttaattgatccggcgtcagcggaatcagctgaagccgttctgtctctatcatcaatttccttttcctccatcctgtatctccagtgtttcgtatttaagcattcatcataccataaacacaaaaattgcgaaagacctcatccagcatttcccgcacagcccggtattctcctgctgttctgcctccaaaagcccggtgctccgtttcgttccagcttcatcagcatcataaatataaaaatccccgccgctttgaacctccgcagaagcggttcagtcaagccggcgggaacattctattttgaggcttccggttcccggcagtctatcccataaggaagactgccagcagatatccaagtgtcaggcagagcccgatacagaacagcatcaggccaaaggaaaagctttcttcgaccagctttccggtccgtttcagctcctcctccgcctctataaaacgtggaatcgcagacgtacggtccgttttgattttcctgccccgcctgcctttccatgccgcgatttcatccgccatacctccaaggatgtaggcgagtctgtcattttcccttatttttacggttcccggcagctgtcggtgagtcgtctttctcgcaaggagaatcaggccgtcgacgaatgaatccatggcccggcagactacggaggacaccgccagaaatacagtcaccaccgtggagaccaggtaccggtcgatcaaggcgcataccgtgccgcagattccaggcaaaatatgcagaagaagcggccggtaaaccagattctccagatccagccaggacggcaggcggtctgcataaatcgctgtgcctcgttcgtcctttttcatcagaagcaaacgtacgacgaggacatagagcacgacgcctattccgatggaaatgactccgccctttagattttccagagaaaaataagccacggaatgaagcatctcatctccctggaaaaagggttcgcctgctctagcgatccggtccatggacagatgcggtgtcatgcccagaagcggaatgagcgccgaacagccaaccagcacgaaacggctgagcggcttcatgcaggaggtggacatcgcgtcgtacttcgcctgctcagtcggatgtttttccacaaagagggcgataaacagcttcagcatataggccacggtcattcctcccgtcagaagaaacacccattccgccgctttccagattcccggattcagcagaagcgatgtaacaatgccaggcattccggcggaagcagaagccattcccggattcaccaaaacggcggccccttctcccacggccttcgcatactccaccatgctctcatggagcagcgtcttgctcacataaccgctccacagcgggattccgccgatccccaggcttcccatgaggaaacagaagccaagtgccggcttcttcctgccgaaaccgcggatatcatttaaattcagcttatgcagattcatatacaccgccccggcgcagagaaagagcaccagtttaaacagcgaatgattgaccatgtgaagaaatgtgccccacaccgccagaccattttcttctcccacgctggaaagaagaactgccataccgattcccgttaaaatgaatccgatctgagagatggacgaacacgccagcgtcctctttaaattaacggacagcagcgccagaagcgcgcccagaagcatggtcacaagccccagcatggtgaggagaagcccccagtttccatcggaaaagaacagccccccggtaatcacaatgattccgaatacgccggccttcgtcagtattccagacaacagcgcgctggccggtgccggtgccaccggatgggccttgggaagccagatatggagcggaaagcagcccgccttggctccaaaaccgaatagaagcagtccccccgcagtataaagctgtgcggcaggcgaaaggtaaccgccgccgttctccagggctgcccgcgccgccggaccgatcagatccatatccagggtccccgtcaggtcatagagaaggaacagccccatgagcatggcaaggccgccgatgaccgccacagccagataggtttccgctgccttaaggctctccttcttctcgtcaaatgccacccagacatacgaagtaaaggacatgatttcgaagaaaataaaggtggtatacaaatccgcagacagaaacactcccacggtagcaaaaaatgtcacccataaaaaaacgtagtatttccggcgtttctcatagtgagccatgtattccagggaaaatgcaccgctggcggcccacatcaatacggcgatacaggaatagaccagacggaagccgtccagcttaaaatgcagtcccatcccacagaatccgggtatcgccacatcaaacagggtcttcatccggcctcacctcctatcgccgtaagcaactccatcagaggcccggaatacaggccaaacaccagcactgcggccgcgaagatcagaagcggcaccatcatcatccagttgggatcggtgtacggttcctcttttaccgcggcggccgccgcagcctttggaaaatacgcccgcaccagcacagtaagcatatagacaccggtcatcagggccgaataaaggatcacagccgttcccagatacgggagaattcccattctgctgctgcctgccagagcgagactgccgcaggcgaaggccgcttccgcaatgttccatttgctgataaaaccggcaaacagagggatccccatgagggaaaggctggccacagtcagacagccgaacgtcagcggcatcttcttcgccaggccgtccacttcatagacgtatgtctttccggtctgatgcatcacagctcccgcgcagaagaaggaacagatcttcataaatgcgtgaaagaccatgtggcttaaggcggccgccagccccagaggactcatcatcgacgctcccagcagaatatacgacagattgctgatcgtggaatacgccagacggcgtttccagtgaatctccttgactgccatggtagagccgaagataatcgtcaccatggctgcggccataaccacccactgtgccgcgcttccccgcaggaactccgttccatagctgaaataagtgaatcgcagtatggcaaacgcaccggatttcaccacagccaccgcgtgcagcagggccgtcaccggcgtaggcgccacggtggccttcggaagccagccgtggcatggaaatacggccgccttgactccgaagccgaagaacgcaaggatatagacgaacagcagcgttccacggtcgccttcagccgcagtcagggacaggacgccgcccggaacaaattccgtggttcccgtggctgaatatttcagcacgaaaatcaggccaataaaggcgaacgccactccaccgatggagtaatagaggtatttgcggctcgcacgcatggcttcctttgtcatgggatggagcaccagagggaaggtgaccagcgtcagcagctcataaaacagatacatggtgactaagttgcctgagaacgcaattccgatcgtcaccccatacgtcatcagataataggcaaaaaaggaggcccgcctcttttcatgcctcatatattcaaatgaataaagcgttgccagaggccacagaaacgccaccaggcccgcgaataccgagcccatgcggtccagcttaaaccggaccgtcagattcccgtagagcttaaagagcaccagaccattatccatgccgcttctgccggcgatcagcagggccaccagcaggctgtttaaaagcaccagtccttccacgacaatttccagatgtctgtatgttctctcatccccggcctcgtatccggaggcgagaatcgccgtacctcccacgatcggaaggagcgccggcaccgccagtaagattccgttcatacgtattcctccgtcaaagtacggccgcggcaatggattccagcatagccaggaaccggcccgggaagcagccgaaaagcagggcccccgccgtaaatatcagtatcggtaccatcatgcagagcgacggttcccgccctataagccctcttgcctttaattcactctcatcaaagtcttcccccgggaagaacccatggatggtgagaggaagcagataaccggcagtgagcagcgcactgatcagcagcacggccggtcccgcgatcgtccacactcccgttccggaggcaagagccccgcacgccagataccatttgctcacaaagccgctgcagggcggaattccgatcagcgccagggacagaaccgtatagccgcccagcatcactggcatcacccggccgagaccgcgcatctcttccactctggtccatccggttttaaatatgatggcgccggccgccaggaagagtccgttcttgatcatggaatggaacaccacatgggataaggcccccacaaatgccgtcggctccaaaagactcagcccgaacagtatataggagacctggctgaccgtcgaatacgccagccgtttctttaagaccggttccttataagccagcatggagcccataaatacggtgagcagggacaggagaatccacatggtctgtacccaggttccgcggagaagctccggcccgacgatataatagaccacccggattaccgccagtacgcccgatttcgtaatcaggcccgacagcacggcactggccggcgcgggagcaaccggatgagctgtaggcagccatccgtgcatgggaaacataccggccttcgttccaaagcccagcagcatgcagcacaccgctgccagcaggattccttccttcccggcaagggacacacctcccagcacacctcccggagtaaacgccagagtaccggagatgctggccagaaagaggatcccaaacagcgccaggaaagcgcccgccacagagtaaaataagtatttgagtcccgccataaccgcatcctttgtgagctcgtggagaacgaggggaagcgatgtcagcgtcatcaattcgtaaaagacgtacatggtcaccagattggcggaaaaatccagtccgatcagcactcccaggacgattaagtaaaacccgaagaaccggtgttcatcccgttcatgggtcatataggttatggaatagatccctaccagaagccagaccaccgccgtcagcacagcaaaaagcctgctgatcccatccactcggaattcaatggtaatggtgtcagtcagcttccagagcgtaagcccgcctcccgacgccaccgcagcgaaggcgcacagtgctcccgccgtcagcgcagccacgaccaggcacagcatcgctttccggctgcttctgagccgtttcaccgtcagaagcaggattcctgccgcaatcggaatgagaaccggaagcagcaatatcacgttttgatccatctcttggtacataaggtttctgccactcaaaacatcaggaaacttactcacaagttcctttacactccacagtcgtaaattcccgaaatagtcttcggtacacacttacgccagcgtaatttttctctttgagtggactctcctttctaaattttcatatttaaggcggaggatttacgagcttaatagagtaacgcttattcgagcgttgaaagtccggctgcaatcgcctgaacgatcggctgggatttcagtcccagaatcagattcagaaagatgaagcacaggacggccagcctgagtttccaggaacttttcctgactgcggaccgctctcctctggtctcccggtctccctctctggagtacagggtgatgacgaggcgcagaaagtagatggcatttaatgtcgtgctgacggccagaccaatcagcgtgataatcatcttattcggactctggagtgccgacgtggcaaacagcagcttggatatgaagccggccagcatgggaaatcccaccatggagagtgctcccacggaaaatccgattccggccagagggttccggtatcccgctccacgcaggctcttgtaatcctttttatcaccggacacctcatagagcccgaccgcgctgataaacagcagcgccttggtcgccgaatgggtgaacatgtggaacaccgccgccaccatcccggcctccgttccaaggccgattcccatgtaaatatagccgatctgagccacagaagaataggcgatcatcctcctcgtatccttttccagaatcgcatgaagggaccccataagcatcccggccaggccgaagacgaacagaacgttgacaatccggctggccaccacgttttctcttcccaacacgcggtagaatatcttaatcagcaggaaaatataccctttggacacgagtccggacagaatggcgctggccgttggagtcgcatagccataggtatcgggtatccagtaatgaaacggatacagtccgctcttgatggccagtccgacgctgatcaccgccagaattaccagcatgggaatctcatagctgcccgcggcttcgatggcctccaccgccgccctggccgggctcatcagcagatggcccgttacatcgtaaagcatactgagaccgattaaaaacaggcccgagcccagctggctcataatcatataccggatcgccgccgacaggctcctgcccttctgccgtatcatgatcagaccgcatcctgcgatggtattaatctccacaaatacataggcggtaaataaatcgttcgtatagataagggccagaagcgaactgagcatcaaatcgatcattacatagaataagttcagctttgtcccttccacgtcctccgcggtatgatccatgcctcccaggacggacagcagcatgaccacgccgaatacggtggcagtcaggccttctaagacgccggccctgatctcatttccccagggtgccggaaaatgtcccatcatataggtatagctctcccccgtccccatacagaagcgaaggacggcggccgacatgaccgtcgtagccgcaataaccgccaggcttaaattcctggcctttttaccagagagggcacacgacaaaataccggaaaacatggcgatgatgatggagaaaaaaggaaagttctgaacaagagtcatgtcttttcctcctctttcgcctgtgtcagaatctcatccagatccagggaaccgtaccgctcatacaggcggatcgtcagcgccagcatcagcgccgtcgtactgactgatactacgatgcccgtcaggacaaggccgctgggtacgggattgatgtaagccgacacctctctaataccgttcatctcgataggaacggctcttccctggatatacccctttgccgccaggaataaatagaccgcggtgtccatgatgttcattcccataatcttcttgattaagttcttatgaagcagcagcatggtaaatcccacgccgaacagaatcaccgccaccgtctcttctatgttaaacagcaaatggactgccatgtcacatccctccttttcggaacagcgtgtaaaatgcgtacatggtgcacgccacaaccagacccacgcagatgttgagaggcagaatcagcccgctgcttaagatggccccgggagttccaagagggattccgctctctaaatggttcgcgccggtaaagaaagaatagcttttcgccacacagtaaaatgtcagtgcgcagagtgtaattctgcggtacactttctctgtgaagaagcgttccgtcttctcgaagccgaaggcatttaaatagaggatcagacctgatcccagtaccgcgcctccggaaaacccgcctccgggcgacagatggccgtttaaaatgatgtagatgccgaagatcatgataaaagggaccagcacgcaggcgcatttctgtaaaatgatatcgttcttcggttcaaagagccggtcgttggcctcatcgagccgtttgcgcgtctgtgcgtcacggctcaccgcatcgatccggagcagcgccaggacacagcaggaagcgataaacagcacgcacgactccccaaatgtatcgaaggcgcggtaatccagaatcataccggtgacgtagttgagcgcgccggtctcctccactcccttttctatgtaccgggcggacacctcgttgttgtccggatttcctgcattaccaaagaccggcagataggcgatcgtccagagcagaacaaaaataatcgtcaggcacagaagaaccgacatgacctgataaaaccggtgaaacaggagaagcccccgttcttccttcttccgcattctggcggcctttcccggatcatctcccggaagctccgcctgtgctgactgcgccgcctgcgtaagtacctttgagtcttcctccggaacgcggatctccattccgtctgcgagtaggtccgtctcgccgtcgatccatttcttgaatttcagccacaggctgttctcgtaattatccttcttcctgctcatcacggtcctcctttcggatggctctgatcttctttagcgtaatgaaaaagaggatgctggtcacgcccgctcccaccgccgcctcggtaatagccaggtcgggcgattgaagcagaatccatatgatacacatgatcaggctgtaggacatgaaaataacgatggatgtcagcaaatccttcgtaaatgcaaccgataccgcacatacgatcagacagattaaaagaatgatttcaaagagtttcatcgcccttttcctcctccttctgtttcttatcggtttttccctttcggatcacgagaatctcaccgagattttcgtcggtcatggcttccaggcggctgatcatatggccggataccggacccgcagtccagaaaaacaggataaccaggaataattttaaagaatccatggaaaatccacgaatcaggatgagtcccgcaaatacgaacaaaatccccagcgtgtctcccatagccgccgcatgcatccggttcagcgcccggtgaaaacggtttactccaaacacggccagtatcataaaaacaaggcccgtcacgagacaggcggccgaaagtgcgaatctgatccactgccacatcatagtgagtcctcctcttccgcctgtatgcctacgttgtcctcgatcgctcctaaatcggctttccggttcttcttctgcagatagactcccgtgtataccttacagagaacgacaacgcctaaaaagctgatcatggcatagatcaggctcacatccaccaaatagttttcatccaggtaaacggaaaggatggcgatgaccataatcaccatggttcctgtcatattgactgcgataatccggtccgagatcttcggccccagaacggaacgaatgatgctgatgatcatcaggactgccagaatcagggctgccccggttaaaagcatctcataagcctgtcctattttgtccattttgcttccatgtcctccatttccttcagcagctttacgaatacagaagtctccatcccctcggccagttctttatccagacagtgcacgcagaaccggtcgtcctccacggacacggtgatggttcccggcgtcagcgtgatggaattggccagcagaacccgcgccagtcccgtcttgaaatccgtgtcaaaatacacgaaggccggctccggctgaagctccggcgacaggatgatctttaacacgcacacgttggcctttacgatctctttcacgagaactccgaaataacggataaacagcgggatcagacgaaacagcagcagctcctttttcaggctgtattccatgtagcggcacataaaataaaaaagtgcggctgaaatcaaaacgccaaagatacagatttccgccgtcactttaccgtttaaaatcatccacactgcaaaaaataaaagaaacacaggcatatcccccttccgcccagtttgatttactatgtattatacctctcatttgggggaaatacaaggaggtctgcacgtttcggtccgcggcggcagatccggatattacggcagaactttacattcttttaaagctttttggttgtatcatttttcctattgcgatataataaacatgtaacaagaaaccaatgaggaatgtgtatggatttgattaaccagtttattgaaaattataagaaaaagttgaacttttacgagacggccgggcacatcgcagccaggcagctggaatccgcgcttcaggcagccggtatccgcgccatggtgacatccagggccaagaatcctgtgagattaaaaagcaaggtattgaggaggaacagccggcggccggttccctataaaaacatgagggaaatttacgaggatatcgccgatttatccggagtccgggtatccctctacttccccggagaccgtgacaaggccaacagcctgatcgccgatctgtttaccattatagagactaagcagttcccggagcagtccaagccgcccacctacaacaagcgtttttccggctattgggccaaccattacagggctcatatgaaggaagaatctttagacaagtcacagcagaaatacgccgccgcacggattgagattcaggtggcttctgttttgatgcatgcatggtccgaggtcgaacacgatctcgtctacaagcctctttcgggaaccctgtcggaagaagagctggctatcatcgatgagctgaacggactcgtcctcgccggagagatcgccctggaacggctgcagagtgccggcaatgaaagggtccagagcaaaaacgccacattcggcagccagtatgagctggcttcctacctctacaattacttaagcaataatttccgccgtgaggacatcgagctccgcatggggaatatcgagttattattcaagctcttaagcaggcttaagatgaacggcgtcaaagagatcgaaccggtcttaaaatcagtcaagttcgaaaaggaccgccgcaacatctcccagcagatcatcgatcagatcattacgggtaatgaaaagcggtaccagatttaccgggagctccgcatcgccggcgatgccgacgaggtggcgagcaactccatcacctacttctttaaccagtgggtgcctctggagcatttcctgaaccgtatatcatacaaaagctcgccgaagacgcgcggcgcctttaatatcaataccttaaagcggctggatattctcgacaaggaatgcctcaacaagatcgtcgccctccggaagacgcggaatgtcctgatccataatatcgaaactcccgaggtggatgatttactggaacagggaaatgaggcaagggacttactcgaaaagctgacggagcagttctcctctcccgctcctgcggcggaatctgcgaaacaggcaaactaatatcggtatgaatgagacagcacataaaaagcaagcagcaccggatagatttctgcatctggtgctgcttgctttcgtgtgaaagccctttttctggaaatgtatgcaaaccatgctgtttcagtgaaacatattgaaattaatatggcaggataaaatgagccatttacaaaagtttatccaattctatatttaattgcgattttaaagcttccagttcatcggcgtctggaagatatttttcagcgaataattcatccttctccagctgccaaacaggtccgccattaggggtatctccggttcttctgggaaatatatgccaatgcatgtgaagccctttacctgcgccaagaagttcataattcaatttttccggtttaaatgcattgtacactgcctcggcaacgattgacatttcatgcaaaaactcaactttaaaattgggttctaagaagtgtaattccgttgcatgctgcttgcaaagaaaaaccgtatacccttttatacgttgatggtcaccgataaccacatatcccgtatttaactctctgacaaaataaggatttttattaaccttaatcctttcaatcctttcacagaccatacaatcattcattcccacaatcctccatgccatattagatttttccgcactgcaccgtcctataacatttttcttcctaaatatgtaattaacactattttaattataacagagcagaacataaaaatgaagcgctgcatacttttatttccctatacagcgcttcgaatagcatttattttacaaagacgtaatttgcaaggtaaaacagcaaaaacgtatgtgccggatagaaaacatagaaaaagtattttaatccggggcctttctggttattgtagctgagcatgaacggcagggcgagcaccatcatccactgtgtggcggtgcctgcggccagcatctcctcgctgaactgggcgatgcagaaaagcagatacacgactgttaataaatccttcttctctttcaggaaatacatcagcacgcccaggacaatgaattcaagcccatactcattcagcgccagattgggaatgactccggtgagcgtatctccgctgagactgtgaaggaaggggaagaagccgggcatcatataaaataagacctggacgagaaaaatgatgccgatcatgataccgcccttttttctgtccttcataaacagttcaatggtgctgattaaaacgcccaccagaaacatggacaggaaaatattatggtatccatagtcaatggaggcatcaaacctgattttaatgaagtaagtaaaaaaggtcataaaaatactcatcaggtataaacgaagcaggtattttttccggtctcttgtgtagtgatatccccagaccatactgaataaaaacagagggtaggaagctctccccacccaacggaaccacatcggcgcaccttcaaaatagagtcctgcgtgatcgagaaacataaggataagggctgtgatctttaacgcgaatgtactcattgtcaacctccatgttgggaattattgtttagccgtcctgatcctgcagcgtaaccgcaagaaccgatgggtagtaattcttgagttcttctacaggcacggattttcccttatacttctcaagccagtcctcatattctggattttcccatacctctccatccgaaaatactatcctccggtcgcagtaaagcgcataggccacccgatttggtccgccgtctccgatcttcggccatcctgtcatcttctctccgtcataaagcgtccagccggaatcagcggacgccccgggtattatctcgtcatgatcatcgtacagacaggcatatgccggtttatcgctggaatccatgatataccattgaagcttcagcggctgcccctctttatcgtaggccagcatgcagtactgtctggatgagatggttttatcggtatgattggtgtaggtatcatataaatacggccatccgctgtcttcatattcacgcagctccacgattctggaaaccgaatttcctgaacccactgcctttttctgattgccggtgctctcacacggatttgccgcactcgatgtctccgcagcactcgatccccccgtcacgcccaatgcctccggcgcacacgatattacgccgacgcacagcaacgcaaaaatcacaactgccgtcatcactctttttctgttcacagaacacctccctgtctgattctcatattcttatctgcgacaggtaaatattaccacaaaatgcttgggaaacacggaatgaatccttaagaaagatggatggaaatgtgcattttatcggatatggctgctgtttgtctgaaaatatgactatgtgaaagacacttgtgaaagggtacagacaaaaaatcaggggcgttctgcgcccctgaaaattctgttcctatcaatgtctcttaattttgtattttcattatccccaaaccagtatccggttcattccttctttcaggccttcaatcgggcctgccgcaggctgtccgttcctggactgatccagatagtcggtatcgaatacgattggtgtgccgtccgggttttcgtacgcggcctccgtgatgcgcggcgttcccagttttccggaattgtagatttctgtcggaatctccagcatctccttttccacattcagctccagatacgtttttccgtcagcctctacaatccgaacggcaggatccatatcgcttacgtgcgtattttcttcccgtccatagggcttagccccctttaagtaggcgtttccacggatgtataccggctgttttacatgcttgaactgctctaaatcaccgtttccacgggagatgacatcgctgatatactcttccagggaattcgtatggccgtcatagccctcggttccgtgaagggactgctccgtataggtcacggctcctcccaggaatacgttctgatagatccggtcgtcaccgctgtaaaccaccgtggttcccgccacctctgtcgtgtgagggaaatggtaaggagtggaccggtccagcacgtcctctctgcgcatggtgccgcagcagagattgtgaaggtaggcgccgccctgggcgatattgtcgaaattataatcggatgcaaagatattgttgtccaccagatatgggccgtgggttacttccaccatgagatcacggtcgttggcatagtataagttcttgctcactctcgttccctgggcctgccagtccagccacgttcccagcgtgcagttatgtatgttgttgtgatgaatctgtacatcgatggcggcgtgcagcttgattcctccgatctcatatccgaaatattcatgctttaccgcaatattataaatatggttatgggcaatctcgctgaagacacagcccatatggcccacgataccattctgtccgcagtcataaatctcattgttccggattacgtgggaaccgatcgtctccttgctccatccgatctgtcttgcccggaatacggcttccatctgatactggtatcccggctttctgtgggtcctggtacagagattatggccggtggaggcttcctttccaatactgattccgctgcatttggcatcgtgaatcttattcttctcaatgatccagcccttgctccagttcgttcccagaagtcctggctgatctgcggtcggcggggtccacgggcatgccgcctgtgccatctcgaagccgcgtaccgtgatatagtttaatcctgttttctcaggatagaaacaacatttgcgcacgttgatttctgtcagttcctcgttgggattcacgccctggaagttggcatagatcaccgtagtctcctgatctgtctcggcataccactgatacatggtatcttccggatgcagaatcggctccggatgcctggtccacggcggattcactccctcggtgcggataaccggattcttcacttcctccaggctcttcgcttcataaaaggattttccatttaggtagacgtccccggcgtgcagggaattgtcattcggatagataaaccagtctcctcccagaacctccttatacggattataggtgccaaagaaggaattgggaagtaccgctttccagacactgccctccaccggctcccagcacgtgatctgctcagaacccttgattacgacgcgttctccttccgctgcctcgtatgtaattcttgaaacactgctggttccgccctgcgctggttttacccactcccggtactctccctcatggacaatgacacagtctcccggcatggcgagtaacgcggccttcgatatggttcggaacggatggtcctttgtgccgtcttcaaaatcacagccggttaccgccacatgatattctctcattatattacctcctggatcaatgatgtacttaagatgacttaaatatagcagattatgacagttttgactttacaattattgcgccatctatatcaatagttgcttctttaaaatagcatttttaacgaaagaaggcgggatacagcggttttatattgcattcttgccataatagcggtatgatagcaggaaaaacagcgcactttttttgtttcaatttgctgtcatggccttttgtccgctgtttgcgctttcaggcatatttttatttccgcaggcaataagccagacagccatgccggtatgtccatccggcgactgcggcaaaggttaaggcccttgcggcgatataagtttgacgctccgctgcctgcagcgggacttttgaccctgggaggtaatcttatgcttacagatggttttccagctcggctgtatgaggatgcagcggctgtgctgtcacgtatttccagaaacacataccatgatattccgatcacagagacgggcaggacctgcacttatacgctgcccgacagacaaacggtttcatttccttaccgaatctattatgtcgatacgtatgaggacctgcgctccgggttatcatggacgcagagaatgatctgtcacgccatatttacgagaagctttgacggttatatacgggagaaacacgtaagggcaatccttctggaagattatccggactggtgttttccatacatcttaaagctttcggatgagtatgtagccgaaattctggagctgatctaccatgaaatggcaggaaaaaatacagaccggatgaaatcattctgccgccttaacatgaattcgtttctgctgagccatgaccggatgatcagctactggaatgagttttaccgtcacaactgttttcactaccgggattacattggcagaaagctgttttcagagtgctttggatacacgcgaagcatggaaagggaacgaaaggggattaccaatgattgaacatcttgacggcatcttcgagacggtcacgttccgtgaaaatctccggatgcgaatcagtgacatgagtatttgtgaaaatttcccggatcactggcacactccgatggaaatcatacatgcgaagaaaaactggtataggatcgtggtggatgaccagacctaccagctaaaggagggggatattgccatcatccgtcctggtaccatacatgcgctttacgcgccggaaacaggcagccggaccatctatctggcggatttatcatttttaggaggggtctccaacctggagaccatgctcgccctgctggcgccggtaaccactatcacgcctaagggagagcctgatctgtacagaaaggccggcgaactcctctccttcatggaagaggaatacgccggctcccggtccttttacgatatgcttctttatggcgcgctcatcgagctgctggggcttcttggacgatacgccatctccccgtccgcctccgtgggcacgctgggtccccagtccgccaaatacgcggaacgctttctttacgtctgcaactatatcaatgagcactgtacggaggacttatccctggaaaccatcgccgggatcgcgggcttcagcaaataccacttcacccggctttttaaggatttcacacatacctccttctaccgctacttaaacaaaaaacgaatctcccacgcggagcagctcctgatcaatccggaatactccgtaacggaggtggcactccagtcgggcttctccagcctttcggccttcatccgcatgtttaaacagctgaaagggtgtacccccacggagtttaaacgcatgtactcgctggactgcatgaaccgtgtggatggtgaaccggcagcggaactgccgtcaggaaaataatgctttcgcctgccccatacgttccaccacatggacgccaaagggacaccgcgtctcacagcttccgcatccgatgcagtcggccgctcccgcagacagtccgtcataatgtgcccgcagggaggccgggacctcattctgcatgactgcaagatcgtaaagcttatttaccatggcgatatcgatggccgccggacatggagcacagtggccgcagtacgtgcactgaccggcatatgcgtggtgaggcgcccctgcaagcacggtcgcgtaatctttttcttcttctgacgcgctctcgtatgccacagcggccgccacgtggtccggggtatcgtatcccaccatgacgctggccacagcgggtctggtcagtgcatagtggagacactgaaccggtgtcagcgccacgccgaagggagacgcctccgccgagaacagccggccgccggcataccccttcatgacagtaatgccaacctcttcctgctcgcagatccggtacagctctgccctctccggcgcaataccgcccaattcctcttcgtaccgctccttaaaataatcctctatgttctcgctggcgggaagcatatcaaacgccggattgatgctgaagagaatcatctcgatctcaccgcacagcgctcccatcttcgccaccgccggattatgggtgctcatgccgatatgccggataatcccctgatccttcagccccctgacatattccatgaattccccatttatgatcgactggaactctgcggcctcatccacgaaatgaatcattcccagatcgatataatccgtgcgcatgcggtccagcaaatcctgaaacgccggttttaccttgtctaaatcacgggttctgacatactgtccatcctgccacgtggaaccgatatggccctgaatgatccagcggtcccgtctgcccgagagcaccgttccgatattggagcgaacgttcggttcggccatccagcagtccagaatattgatccccgcctcctcacagcagtcgatgactgcctttacctcgtctgcattatggcgttccagccactcgccgcccagaccgatctcgcttaccataagtcctgttttccccagttttctgtagttcatatgtatttcccctcttcttcctttattcccgtaccacgggtttgtaatccattttggattcttcctcggctgcttctatcttgttagtttatttatttcaatccccacccggtaattgctcagagtgcggctgcatcatttatcgatgcgcagcttgacttcatatcagtgggggatagcgtttttttccgcccgccactgccgttaaacttgtttgttgcgattcagccctccggtttcacgtaatcagcaaagaacatctgtcccgccttcaccatgggacatgcctgcaatcccggtgctccgtactctttcgccagttcctcatccagtgttgtctttcaaacggtgatcttacaccttctcatatttcattccttcaattcaggtttacaacagatgctgtggtggttcacaatttggacttgacattcgtaactgtaatatatataattacagttacgactactctttttatatatttcattttaatcgaattgcggttggctttcaaccactttcgatggtgaggaggattcatatgatcgaagaaggaactgtggtctattacctggacgaggatgcggttcattctggtcgggtgattgatgtgacaccggaaaacggtggattcacattcagcattgacagttatggagcatgcgagggaccgtacgtaatcgcttccggacaaatcggaaagacggtatttttctcggaaaaagaggctgaagacaggctgggaatataatttcccagcctgttttatcgtcaaagacccaggataggaggacactcaatgttgacacctgttaatatatatggtactataatattaacaggtgtcaacataatattatcatgtgttaatatcgtttgtagaattcatttatttaagaataaaacacttcagaaaggctgaattatgaaagaaaaaccataccatcacggaaatctgcagacagagctgatcgaagaagggctggcgctgattcacgaggaaggaaaggggaatttctcgctgcggaagctggctaaaaggctgggggtctctcccaccgcctgctataaccactatgctgatgtcgatgacctgatgcgcgagatgaaaaactatgtcacaaggaaattctgtgatgcgctgatcgagggcacggataaggatgatcccgcgggcgccgccatcaacatgggaatcgcttatgtagaattctttgcggacaatccccactattttaccttcatctatgacagcggagattacaggattgatttgacagaggatacctttgacggagactttgaaccatttcaccttttcaaggaaatagggctgctgtgcatggaatataatcacgtggaaaaagaaaagcacagggacaatttaatcgttatgtgggccaccgcacacggactggccgccatggcaaatatgaagggatttcactataacggagactggggcgctctcaccaaaaagcttctgtacgaaaaaataattttatcataatgaaaagggagacaaaacatgacaatccaggaagcgataaaaaaccggcactcggtcagaagctatcaggcaagggaaatagacgctgccacggttcggacactgaaggaagaaattgagaaatgcaaccgcgaaggcgatctttccatacagctgattacaaatgacagcagcgtcttcaagggactgatggctcattacggaggcttccgcggtgtctcaaactacattgcactcataggtccctccggccatgatctggaagaaaagctgggatactacggagaacggatcgcactgcgggcgcagcagctgggactgaatacctgctgggtggcggtcacctataagaaaaagctgtgcaaggcagtcgtcaagcagaatcagcagcttgtatgcgtgctggcgcttggatacggagacacccagggcgtccctcacaaatcaaaaccaatgccgcagctttgcaaggtggacggagagatgccggaatggttccgaaaaggcatggaagccgccctcctcgcaccaaccgccatgaataagcagaactttctgattatactggacggggagactgtgaaatatgaggcaaaggaaggcaagtaccgcaatctggatctcgggattgtgaaataccattttcaggcgggcgcaggactttgatacaacggtatggaaggaaaaaagcggaagattttacgctgtagagtgtaaaatcttccgctttttatgaaatacttttattcatccctttatgtatccgaaatatcctcagtaatctttagttgataaaaagctgggtccagtaatcaacgccggccgcgttcttataatggccgattccgattgagctgtaatttgcattcataatattagctctgtgtcctgcgctgttcatccagtcctgcataacctgcttcgctgatttctggccgtaggcaatattctcgccggctgctctatagctcacaccagctgcggtcagtgctgtggtaaagttgcttccgtccggtcttgtatgagaaaaagaggtctcgatctctcctgctctctgctgtgccgcacgggtcgcgcctgcatgaagggtcagcgccggaaggcctgctttggcacgttcttcattaacaagcttcagtactgcgcccacggcctcatcctgattttcatcggacggctgatccggtgtcggaaggctgttgtccggaagctccggtgttggctgatccggtgttggcaggctgttgtccggaagctccggtgacggcagttccggtgtcggaaggctgttgtccgggtaatccggcattgggtaatccggtgacggcagctccggcatcggcagactgttgtccggcagcatatcgcccgggtaattcgggaatacaggctggcagtccggggagaagtttactccgggaatctggtttaagatattattgaaatccatccggttattcccggtcaccatgataactcttccgccgcctgcggaaaaattatatgtattaacggctgcatttgccgtcgacgggatggtgccggccgttgccagtgccgctgctgcggtcagtgcgtatgcggttagtctcttcatgtttaatacctcctgatattgttacataattgttacatttctgttacaaaaatataataacacaggatggctggaaattgtcaggaaaaggctggaaatcatttttacagatacagggtgttcgctttgcggccgctgcaggcctttttcatcttttgttctgctgcaaacagcactaccttatcattgcggcgcgcctgctccggacatatggcgatacagtgcatacaggagatgcagcgttccttgtccagagatgacggattatccttcgggatcgcctggaccggacattctgcggcgcactttccgcatttgatgcagtccttgtccgccttcggtttcatcggaacgccgtgatattctctgtacggatggccgccaggcactgatacctcgccgtcttcgttttcctccagatgacgtttgatccgttccgaaaactctttcagttcccggcagtcttcctcatccggcctaccggcgccgaacttacgaatgatcgaatgctctgccacagccgctgcggctgccgaacagcgaaaaccagcctccgacagcgcgtcttttaattccatcagcgtatcttcgaattccctgtttccataaacggccaccagaaccgctctcgctccgttgcccgccatctttttcagacgttccactgccgttaccggcactctgccgccgaacgacgggactgctacgatgcagatgtcatccgccgagaagacgtattgttccggctgcagtgccggattcatcagatcaaccctctctgcttcacacgcccacgcgcctccaatgatctctgtgaccttcttcgtccctccggtagggctgaaatagatttcatacattgccatattattgcctcctgatttttatttctggggacagtcagccggatggcgataaagttagtccacccggctggcaaatgcctcgaattttaaacaccccgccgttcgcggcggggatacttgattcctttgattttatcacattccggctgctggtacaatgattttcactgtttccctcgccagcgcatgactgccgcgttactgttcacagcccccgccggcacctgcctcccggtctgtcccggcctgctcatgcggcctttcctgtgactttgcagggtattagcaattcttaacgcgcaggatttttcgttcaggggaaatccccacctgtttgagcgcagcgagtttggggatttcccctggtttttagaaaaattctgcacgtttagaagtgcttatgcccgaaaccggaactggaaaggccgcatgagcaggccggaacagaccgggaggcaggggccggcgggggctgtgaacagtaacacggccgccagcaccagttctatttctccgtatagcttgctttcacatccacctttttctggaacaggaaggccagtacaatggcaactcctaaaatacagcagtttccgcagatctgagccatggaagtcgtcacaaacagcatgaccacggatacgcccgcaaggaacatcgcggcgatgcagatcaccttcaatttgccgtcactgacgtagaaggaagagcgcttccacagctccggcagctttttcggcagagccagtgcgacaaatgcgatgacgccgcggatggaggtcgtcaggatgaccgtgctgtttgcaatcgtgcttaagtccagtcctgccaggataggaagtacgctgatcaggtagatggcagcgataatccagtgggtcgtgccgaaccgtttgtttgtggcggccaggcctttcgggagccatccgtcctcgcttgcttttttcagcgggtatacgagcatgccgatattgaagttcagtgtcgtcaggagggcaaacattgcgccgcctactacgaaaaaggtgtataccgctttcggcatgaaggagaccgcagagacgctcagcggctttccggctacctcctcgaccggaagcacccctgcggcgattgtggacattaccgcgtaaaggatgacgatagccgcagtggaaacgataataacgaacggaatatccttcgtcggattcttggcttccgcgctgaaattgaccacataggtcgctcctccggcggcaaaggtcaggtaaatggaggccagaacgaaaccgctggctccgcctgtgaagaatctgggggactgcgtgtagcccggctgaatgtggccgatgccgaacacgatataggcggcaattcctgcagccaggatgacgcacatcagattctggagcctggccgcctgcttcattccaaccatatgcataagtgccagcacggtcaggacaacgaaggacaccagttttgcgttagctcctggaaacagcgacagaaagtattcactgaaggacagcgtatacatggataacgccagcgccattgcaatctgaatataaataaatactcctgccagcctcttgttccccagcaccgcgatctgagaatactgaccgcctaaaaagttcgccgtacctccgatataaatctgcggaatagccgccacaatcgtcagtattcccgccagaacataagcgatgttgacgcttctccccgtaaatccgattgcaattccggtcatggtcatgatccccacaccaataatctgaccgattgccatagaaaataaatccgctctcgttaatttgttttcgctcataccaattctcccctttatcctactgcgtctttgattcgccgcagcgccgtctccagtgtttttctctgacagccgatattcagccgcagatgcttctctccgccttttccaaaccactcgccgggtacacagactactccggcacccaggttcacccgttttaacagttcctcatccgtgatgccgtattctgagaaatcaagccagcacaggaaggttccctccggccgctccatccgtaccgccggcatctccgtccggataaagctgcataccaggtccacatttgcctccagatacgcaagcagtctgcccagccattccacgccttcctccgtgtagcatgcctgaacgcattccacgccgaaggtgttcttaatatccagagacatggcgagctgcatctcatcgaatgctgcctttatctccggatttggtatcagtgagaagctcatcttcagccccggtacgttgaaggtcttaccaggagccgacaaatggataaacttcgaagcgtaccgctcatccagggaaagaagcgggtgatggcagtgatctccgtatacgatgtcggaatggatttcatctgtcacaatcatgatattatgttttaagcagatctccgccaggcgccgcagttcttcctcgcgccagactcttcccaccgggttgtgcggactgcagagaatcagcatccggttgttgggatccgcggccagcacttccaggccgtcgtagtccatttcatagtgaccgtccgtgttcttcaggcagttaaacaccggaacccgtcctgtccgtttcacaatgttgatgaacggatcgtatacgggagtctggacaatgattccgttcccttcctccgaaaaggcgcgtacggcaatgttgatgccgctgaccaccgatggaagagctgtcacccagccagactggatgtcccagccaaaccgcattttctcccagtaagcgaccgcgctgtaaaaatcgcttcccggcgcacagtagccgtaaatctcgtgttctgctctccttttgaccgcttccacaatccctttcatacagccgaagtccgtatcggcgatccacatgggaatcatgtcgtcccgtatgggctgggataagtaggcctcgaccccggcacggcgccattttaaatcatgggtgcttttccggtcgaactcccggtcgaattcctggtcgaattcctgatcgaatttctgatcgaatttctgatcgaattctccgctgaacgctccatcaggttcccggccgctttcgcagaattcttctttgcttttttgcatcttggttctcctttactttagttactaaagtaaatattcaaaaaaaatgacagcatttttatcaattcatttactttagctgttaaagtaattatagacaaagaatcctctcctgtctatggtagttttagacaattaggagaggattttttatacaacctgccgattcattcgttcgctttcgtgtgcagcgcacgccggaatatccgttccgcctcgattaatttcatcacttcttcatccgaaaaatcatggaacatgtcgctcattgacatcagacttcttctgtcatactccaagtgttcctgaaacagcctcgccccggactccgtgaggctgaccatggtccgccgccggtccccgggatcgggaaaacggctgaccagtcctttcttctccagctttgtcgccatctgggatgcagctccaagcgtaacgtcgagggaactggccagatccgagatggagaccggattctctggatccgccgaaatgataaaatgcatctccctcatataaaggtcggttccgggagcgtattctctcagagtatttaagtaatgctcgtgtactatcgttgtattatgtttttcgtccaaatactgtttaaaaagcgtaattcggtccatgtgatttttctcctgctcataatttctatcctgccgcatccagcctgcactttccccacatccggcctatccttccttcgcttccggcccgccatacttctcaaaccgtccctttccgctcttcttcacccggtacatcgcctggtccgccagatgaagcatctctgtacagtcagcacagacctcgggatagatcagatacccgcctgatacgctcacctcagcctcctcgccggcaggcagcgtaattctggcctctcttatactctgttccagccgttccatgcacgcgtacagctcctctttctcctccgcgccgtagatcagcagaacaaactcatctccgctgagccgcgccgccagcttctcaggagccttgagaccggcaaacagatccgcagcggtcttcagaagcttatcgccgtattcgtggccccaggaatcgttgacatgcttcagattatctaaatccatcatcagaagcattgccgtcttcagccggtccggatctgcaaacaactggtctgccgtgcggaaaaatgcccgccgcgtcaggagaccggtaagcaggtcgatatcgcgttcctgctcgatctgctgtttttccacgattgcctccgttacgtcgataacgatccccagcgtcttcccttccccttcgtacgtcttgatcctcacgtaacggcgctcctctccgttcaggcagcagatttccttctcttccttcagcggctcggaacggatctccctaatcttttccacgaaaagcgccctgtccgcaaggacggcagaaagctcctcctccggtatcatcagaatctctcccagctttttcgtcgccagcacgcgcttcatatcctgattgtactcgtaaactgcaatcggaatatcgacgttctggaagaccagggacagctttcctgtcgcctccagaaggctgccgaccatgcggttgatattggcgctcagttccttgaattccggcgtgtgatcaatctccagactgtagtcgagattaccggcggcaatcttctgcgttccgtctatcgtcccgtaaatatcgtttaaaataaaggtatccagcatcttaaggatcaggaacacggtgacaaaggagagcacgcagaggctgaaaatgatcagcatcatattgcccggaacgttttcgtagagcttctcgtatgtagcgctgacgcctaccaaaataccgtccgtcatctccatcatgcagtaattcttctgcccgtcaagaaccatctccctgctatagagggtgccttctccgatgtcttcaggcagacagagtccgagggacgtcagcggagtccccaccggtatctctcccgtagctccgataatcgccctcgtgtcctgatcagccgcgaaaatagtgacgcctctctcggtcgtcatcatggaaaatacgtaagatagctcattcttttccatggcggccatcaggcgggccggctccatgccgatctggacgattcctccgtgatcctccctccataccgcgacgtactgcatcatcttgccttccgcggtgttgggcgtcacgtcctggcagagctgaaggctgtcgtcgtcaagcatcggaagaaagaactgcatctgttcccccgagcgaaacgtataatcgtaatattttggctcggaaccggcataaaggcggccctccatgtcaaacagatgaagttcatcaacctggagcagtgaggcgatctttcgcatttcctctaagtctcccaccacgtccggctggttctgtacgatatacgccgccgcttttgcccggataaaataatcctccttcagattctcccgcagctccgcgatctcggtgtcatttctcttaaggacctccgaaacctggttgaaccggatctctgaattcgttctcatcgcttcttttgccgacttcgtcagcagatagtatccgagaagagccatcatcaccatggcggtgatgatcacgacgcacaatctgaacgtgatggcttttttcatgcttcatcctcctgtctgattaccggcagtatattacttttcgaaccattgatccggctgcggatggatataatgggtgtcaaactccgcccatctgtaatcctgtatcccattccgtttaaaaggttccgcggccagatacgactctatctcctccggcttctccgccttcatgagaaatatgccgccgctcatgtccgtcttaagccccgataagaatatcatgccgctgtccatggccttctgcgtataggccatgtgttccttcataatcgcgtcatccatcttcccggcgtccagtatgattccttccaccatataatatttcatgttttccctccgatttcaaagtatgtctgccgctcactttacccagcggctcataatttcaagaagccggttgatctccagcggcttcgccacatgttcattcattcccgcaatccgcgcctggtatgcatcatcggcaaatgcatttgccgtaagcgcgataatggggatctccgccgcatcgggtctctccccggaccggcccagtctgcggatcgccctggcggcgccgtatccacccagaaccggcatctggatatccatcagaatcaggccgtacgtgccgggaggcgacgcgcagaataaatctactgcctcctgtccgttggaggcgctttccaccgtgatcccggacaacgccagcagctcttccacgatttcccggttaagctcattgtcctccgcaagcagcacacgaaaccccggcttaaactgcttctttaccggaaaggcatctatgggcggctccgggcggaatgtctcgccgtctcccgccagctttaagtaaatagtgacgacgaacttcgtcccgacgtccatccggctctccacctgtatggtaccgttcatcatggagacgaggttccgcgtgatggccagtcccagcccggttccctggatccgggagactctcgggtcctccgcccgctcaaagggcataaacagcctgtctataaattccggcgccattccgattccgttatcttccacggtaaattcaaaacagcccacaccgctctcgctggacagcttttcgtccaggctcaggccgatccggccgcccacaggcgtgtatttgacagcattggacagcagattgatcaagatctgcttgatccgcaccgcatccccgcagaccgttccatgctccagcccccggatctgcgcttcgtacttctgctttcggttttctgcctccggacgtatgatctgggccacctcgccgaccagtttatctaagtgaatcacctcttcgctgaggctcatcttgccggattcgattttcgacatatccaggacctcgttgatcagttccaggagatgggctcccgaaagactgatcttggagaggcagtccttcaccttctccgtgttctgcaggctgctctccgcgatcacggtcatacccagaatggcgttcatgggtgtccggatatcgtggctcatccgggacaggaactccgacttcgcctgattcgcctggttcacggactcataggcttcttccagcgcctgctttgccctcttttcctcttcgtaatattccagctctctctgcttctctttattgatatcacggatcgccaggattaccgtcctgggctttccgtcctttaccgccacctggtgaatctccagcctcagccactccgcagaccggttatggcggaattccgtctcgatatggacgttctgctccgtcagtacccgttcgatctgctccctgctgcaaagctccgccaccctgtgtttatcctccggcctcacggaatccagaatatagccccgcaggccgccggtatagccgccgttcctgggcggaggcgctccccggcccgcttccggaagacggaccgcatagtagctgtctgtctctaaatccacgtaataaatactgacatacacgccgccgatcgcctggaatgctgactggctcatatacaggcgctcactgttctccgacagctttgctttcatcttatggatgttgtggagcgcgccaaccacccggtacggcctgccgttctcctccatcagcctgctgtctgcccggaaccaggtatactgtcccctcactccatccggagtggaacagcgcacctcgaacacctcggaacggccgcagcagatattatccagaacggtcgggacatcgtccggatgtacgatctgctggtcaagaagaatctttgagtagtttttcagctcgtttcgcagaattccctgccctgccctgggttcgtagctgataaaggtatccgaatccatcagatactcaaacatgaccgcagaactcgcttccatggacacccggtacatctcctgttcccggtccagccgctcttttaaagcctttctctgggtaatgtccaccaccgtgcgctggagaatggcctccccgtcggctgtgaagccaacgatcatgctggttccttccatccagcggacagaaccgtccttccagcctacacggtattcgctgtctctccggtctccaacctgcttaagactgtcatacgcagcacgcagaagaaggcggtcctcctccagaaccgcgcccagcgtaccgtcctgccagtccttaagcccttcctccatcgtcccgtaacccatcagcgataaaaccgctttatttaaagagacaaggcggtaaccgccgtcatgctcccgtacaaaacggatgattccgcagggaaccgtgtcgtaaatactggagagcagctgtgcctgctccctgatccgctcggcatcctcctccgaacgcgtaatgtccagataaaggctgttgaccatccatctgcctgacgtatcctggcacttctttccgctgtcaatcacccacttcagacttccatccctgcagcgcacccggtaccgggtggaataggtaagaccgccatcccgaaacgcctccgcgcagtctgagagcgccttcggcagatccggcggatagacgttccccaccgcattgcccccggtagcctccataaactcttccaccgtatacccaaagagagccgccgcctccctgctgacaaaggcaaaggaataggtgtcgtcgtcgttgctgatctttaagccgcccgcgatggaggacatgataacctccatctgccgcttctgctgtctcagctcttcctccagcgccgagacgcgctcctgcacgtagtcgtaggactgcctgcctattttttccggaaaatactctccggccatcatctcctgatacggattggagcagtggatatgattgcacttaagcccttcctccgtctcctggaacacaaaggttacccgctgatgcacctttaaatacatctcggcgctgggatctgtggcgatccacatccggcccgtcacgatgtaaaggccttctgccggacagatgacctcatactcctcagcatcgatgttgcacttcggaatagctcccctgtatttcaaaaactgctccacacaggcatctctgcccgtgatgtattcctcttcccctgctccaagccatgaaaactccgttgaaaaaagagccgtaaccgcctccacatcatgctcacagtaatgcttatgcatgatataaccagccagacgctccgcctctttcatacgcgcttcccgttctttccctgtctctgctcccacgccgcatttacccgctttccctgtctgcatacccgctcagtttttctgttcactatttcatattatactgaatccacgcttaaaactcaatgcattcttagtcattgcgcaaaataatacggccgtgctccctctcagtcaggaacacggccgtggtcatgtaattgggtatccggtgcgataccgcttactcttctatttttactctgccaaagctcattaaaaatcccagcttctcaatggctttggacgccttccaccagttctcgctgacggcaaactccttcgggtacttctctcccagcgcgaaccaggaccatgtaatatcccacacgccgcccggcttacgcgtatcgatgaggtactccagttccttctccacgatctcttcatttcccttgtaaaacgggctgtccggggcccagataaactccgacggacgcggggtatagcccgcccatttttccgtgtcgcgctcgatggaacggtttacgacctccgccattttccccatcagtccttcacaggggaaagaggcgtttaagccgctcatcatcacttctcccagcagcatacagactccgccggctcccatctctccgaaatcttccgcagcagccgctttcccaaggattcctgccgtatgcttcagggcagtctgataaaccgcagattccggttttccgtaatgaaggataaatgcacacagccccgcggtgattcccatgctctgaagctgattctctgcctcgtcatagctccaccagggagcgcggggccatccgtcgttggatgggatggagaacatccagccgttttcatcgcggccagctccgctttccagatagcggaaaatgccctgcatcatgggatggccggctcccatagcatctgcggctcccgttcgtcttaagattcccgtaaccaccagcgtggcgtaaggagatgattccgggttccagccatccggctccactgcatgtccaaagcctccgtcctcattctgataatatgacagcgcatcgatcacagcctcccggctcccattctcgaagaaataattccagacggacagctccagttgtcttgcattgcggtgaatccaggtgcggatctcctgatagtcgtttttgttcagtactttcatgttcattctctccttccgtgttgtaaccgatactataccagggaatgacgaaaatgtattgtaaaaaaacgacacgctaccggttctgccatgcgattcgcctcgcctcctcgggcgccgtcccgtgaaagcgccggaattccttcaaaagatgagcctgatcggtgtaaccataccggtaaactgcgtcctggatattgaattctttaatggaaaccatctctctccacacgttctgatagcgcaccataccggcaatccgtttgatcggcagtcctacctcttttagaaacagtctctccatctgtctctggctgacacagctgtactcgcagatctctttcacggagatccgtcccgaagaggcgagaatccggtgtacggaattgtacagatccggcttccactccatcgataccagctttctcagcaaaaattcctccacaagagcgatccggtcctctatcctgtttaaatagaaaaaaggttcgaacagcatcctccagtcccggcccagctcctccagtccgatcgttgcatttgacgtatccctgtagtttaaattcaaaaacagtcctgcgctccaaaaatagaaccgtacggcaaaacagctgacctcatcaccgctgatgcggggaactgaaagaaagggctgatcctgaatcccgcacaggtaccccgagatctcctgtctcgtatggttgatacggataataatatcggcacacgtatccgggatcaccaggacgggggcgttcgcttcgctcccgctcttatccggcggaacctcgtcttccatggtccaataacataaaatataggggcgcagcagttcgcacggcctgtattccctgtagcgtccgtccgataagaacggacgcgatgtcatgggatgatacagcctgtggaataccggcgcccctgcctcaattgccctgctcattgtgattcatcgccaggtgatccgtcccgcccagcatcgcctcaaattcttccttcggcatgggttttgcaaatatgtaaccctggatcacgtcgcagtctgcgttctgtaaaaattccacggtgtcttcctcctccacgccctctgcgattgtagtaatattcagctgctttgccatgttgatgaaattggaaaccacgatccgttcccggcgcacgtcccggcttttccggaaaaacaggatatccagcttcagcgcgtcgacaggcagatcctttaataagttcagggaactgtagccggaaccgaagtcatccagggagcaaagaaagccttcttttcttagttttataaccagatcggagaacagctcggtatccaccgcaagaatattctccgtaaattccagttccagcatatggtccggaattccgtatttcttcttgacggccgcatagtattcgacgaagcccggctggaagattccgacctttgacacgttgaccgcgatattcaccggccttccgcccccgtccagatacgatttcagccagatacaggcctgttcaaacatatagcggtccagcttaatgataagatcgctcttctcaaacagcggaataaaacgtcccggagggatcagtcccagccggggattctgccagcgcaccagcacctcggcgccgcagatccggtttccgttctgtatgtccaccttgggctgcatgtaaagccggaattccccatttcttatggcgggctctgcctccgcttccagggtggaatcctccagcgtcttcttccgtatctcgtcatcgtaatagacaaacgcgctgccgtttttctccttggccgtcttatgggccatattggcatagttcaccaggacatccaccgtctgccctcggtcgctctctttcaggcggtagacccccagcggaatctccagaaacggaaaattctccataccggactgttttagatagtccagaatctccttatggccccgggccagaccttcgtcttccctgcatcgcatgattccggtaaaattatccgcggcgatccggcagctcatacagtccggactctccaccatctttaaatactccgccaccatggagagcagccggtcgccctcctcataccccagcacgtcattgataaacttaaaattcttaaaatccgcgtaccagatcaggcaggcggaaagctcctgctccgccaggaattgctccgcgtccttcttaaaaccgtcataattgcgcataccggtcagggaatcactgtaagccagcttcatcagggtcttctgattctcagccgccatacgcctctgtgagctgatcagccaaataaacagcacacaggccgccagaataatcgccatgatgcctcttgcagtctcaatatagctggaacgaagcaccgccaccggaaccgtactgacctggtaccactgtccttcaatcagaggaaggacagtcaccatgtattttcttcctttttcgtcctttacagtgaagctcccactgtcttcctcccggatcctttccgtgatcgcctcctgatttgacgacaaagctgtctcagccatggagggtttgctgattattacaaaatcaccggattcattcaggatatcagaatagccggaatttttcaaaagaggcatatcgataatcgaccttaatacattcgttgcatggactgcacagaggacgccttccgtctctccgtcgctgtttaacactcttgctgcaaaataattgacgtatcctccagccgaattggaatcctcgaaggtcatggatatactcttttccccctccatcgccctttgaaaaaaggctgcctctgcgatggatatcgtctcaatatttccagccagatcaaccatttccccctgtccggaggcatccgcgtatcccatgcggataaaggtattcttatcgttgacatccgccagaatctccataagctcgtctgtccggatattcgccaggctctgcagacttacggacagtccctccagagtctgccagtcaccttctatctgttttaaaagggcggttctggtctgattcgccgcgttatacaaatccgtaatgttctcttcctcgctcttaacaatcatctgaacgagaaataaaagactgctggcaataaaacacacacacacaattactggcagcagcatcccctgcatttccctcttaccgcgttctgaccatcccatctcccgttacctcttctgtagtgttactcaaatcataatatatttgcgaagaattatcaagcagtatgtctcctttatccaagtaccggcggcggggccggggaactgcaacagtacagcctcagtaaagcctgcaaatagtgtcgaaacttgacaagtatgcaaaaaattgttatagtattttttgtaatatttttgtaacatttatgaaaaaacaattttacagaaaatcagaggtttttatgaagcattcatggaaaaacacccggggaaaccgcaccgtaatcactgcggcggccattgcagcagcttttactcttactgcgttttcatcaccgggacacttgaccccgtctctgccggaaacggcaaaggaaggtattatcaccgacggcggttccgtaaacgtcaaagcggcggctgcggttccccaggtcggtatcgagcgaaaagaagttccggtaacccacgctcctgctgcctccgaatatgataacaaggctgtcgccaatgtcaccaacgtcctcaatctgcgtgccgagccttcactcgacagcaaggttctcggcaaatgctaccggggagccgggggcaccgttttagaaaagaaagacggctggacaaagatccactccggaggcctggaaggctggctgaaaaacgattatctcgtattcggccaggatatcaagccgctggccaaagagcttggactgttcacagccagggtaacgactcagacgctgcatgtgagggagacgccttccaccgacgcggcgatcatcgggcttgccgcggcagacgattactatccggttctcgaagagtccgacggctggatcaaggttcagctgtcctccgatacgtccggctatgtctccagccagtacacgaaggtgagtctcactcccggcaaggcagtcagcatagaagcagagcaggccgctctaaaggcctcggaaaataaagagcagaaaaagaaagaggaagaaaagccgaagtatgtgattaatgcatcctccgacgaaatctatctgatggcggcctgtgtgatgatggaatccggcagctactcctacgacggccagctggccgtggccagcgtcatcgtcaaccgggtgaaatccgggcgctggggaagttccatcacagatgtcatctatgccgacggccagtttcccggcgccacgtcgggcctcctggataaatacctggcaaagggaccttcctccgaagcgttaaaagcgacgaaggcagcgctctccggctcaaacaacatcggcgattacctattctttaattctgcaaaacgcgccgattataacaattactcctcctatacggttgtgggcggaaactgtttttataaaaagtaaactttaatagagcgcaaaagtgccggactgccgggaaacatcgtgtttcccaggcagtccggcacttttcagtggtaacgccgccatgatttgcaccgcatgctttctatgcctgatgccggcattccgtttaccgcctgtcttctgcttcactgcatgccgctctcatcctcacagtaaatctcttcatccagaagtttctgcagacggtggtcgcgcagctcctcatgcagcttactcccataccggagccacatggcgtcttcctgaaatatgtattcacagctctgcagctgttccatgtcttcggacaggaccgtatagatcttctttcccgcggcgcacagctcttccgcggacatctccgcttctgtctcaggcttaagcgccgttaagtccaccgctctgatatggccatccgacagggctatcaccaaagcatccttccgttctatcacatccagtaatttttccatctccagaatctcctccttgaaatctgctccctgacaatcatagtactattatacagaacacacgttcttttatcaactactattttttgccatattatccctggacggaaaaagcctggattttcaggttataacacaatggattctaatctcttgtcagtttcctcatccagtttccatacctcacttccaggaaggccggaaccaccttaaatatctggtccgcgttcaggcagcagactaccacgaccggagatgcttttacgacaaacgccataaaaagtgagaccggtatgacgatcagccagatactgatcaaatccatctttaccacaaacatgggatttcccccaccgcggatgattccgttgttggtgggcatctggtaggacattcccacgcatacgacgcttaagataatcaggaacgtattagccatatcccgggtctccgccgacaaatcgtagaggcccagcaccggtatccgaataaaaaacagaatcgcaccggatacaatcccgatcaggacaaagactcgctgaaggctccgcgcatagcttctggccagttcccggttcccggtccccaccgccttgccgatgatgacggacgtggccgcggccgatcccaccgccatggactttaccatcaggaacagggtcgatgccacgctgttagccgcgatggcattggccgtcatatgccccagaattactgtctgcagcgccgtattgacgccccagagcccctgcacggtgagcatggggatcgtaatttttaagtaatcgccggtcaggacacgatcccatacgagataatcccgccttctcaggttgagcctcgtctcttttttcgctatgtagagaattaaaacaacgcattccagaatccgcgcggccagtgtgccgatggcggctccctccacgcccatctccggtgctccgaaatgaccgtttataagcacgtaattaattccgcagttaacaaacagggtaagcaccgacagcttaaatgcgatcttcaccgtctccacactgcggagcgtagccagcagaatctgggtcactgcaaaaaacagataggtaaatcgaatgatattgagataccgggcgccctcttcgatgattccgctgtcgcgcgtgaagattcccatgacacggtacggaatcaggctcatgactgccagcagaacagccgagagaatcagcgcgaaacgcatggccgacgacgcgagcttcttcatgggctctgtctgatgctttccccagtactggcttcccacaatcaccacaccgtctcccagtgcatgcaggagctgctggtacaaaaactgaatctggttgacagcggccaccccggccagagccgtctcgctatacgctcccaacattaaattgtctgccagattaacgctcagtgtcaccacattctgcagcaccaaaacgaccgccagcgacagaaagcggcggtataattcccagtcttttttcacagtctcttccctcgaatatcaaaaaatgccgtttttcggcaataaagtcctatccattatacatcatcgggaaaatatttccaagattaaagaatcacaataaaatatccctgccgggatcttcatcacaaaatcatccaatatatggcaaatctgtctctgcacactgccgcgctgccgtgatatactaggtacaacttctcctgagtaccgcttttcccccaaacagcgcggtactctttttatttgtcagagtgtctcatttttatgcggcggcttttccatttgatttatatttttcgttctctcaccggaaccaggagatccagctgaaactcttccggctccgtatttgccagttccacatggcttatataatttaagtgttcctccagcaggccgcacatatgctcctggtccgccatatctcccgcaaactcgtacttctcattgctgttaacccaattaagcagcagatcccactcattaaaactgccgaaggaaatcatatgggcggcgtagatacctcccacaaacagtttctttacaagcggagccgggacctccatgtcctccgggatcgttacccagctctcatatccatggaaaccggtcgcatctgttggatttggatgattaaagccatagtgccttaagtcaggctttcttctatgaaggcctgtctccctcacaaaacggtccagcatctcattcacatgaatttccggctcatcgccgacatagtgtacagccgccacagcggaaggcggcaggtagataatccgtacatccccgattctggacagtcctgcttccgctttctttaatttctccatcgtctgatcctccttaaagttaatgctgataaggccgagagactcaatggagtctgccagaacatcatccttcagcagaattttctccaaaggcagttctgcggttctgctcagttcttccacaaaatggttcaatatctctttgaccacagagagtgccgtcatttcttcatttagatttctaatgttctcgcggaatatttcaatcgccgctaccgcgtcctccttctgcagaatcgccttgatctggcgcacagggatacgcagcctgcggagcatcagaatctgcttcagccgcagtacagcctttttatcgtagatccggtatgcatacccctcctgccgcaggctctccacgaggcccgcctgctcgtaataacgcagcatcctcgtggatatccccgggctcctcgacacctggctcacagtcataagctccatggttctcacctcctcatgacttgagtataaacgacgacacggtgtcgaagtcaactgttttttgtaattcatgcgatcatgcatttcattttatttttctctcaccggcacgaactttgcccggttcatcaggggatgctccagcctgacagccccttttaccggacaggccatgacgcaggcgccgcagtagtagcattctcccggatacataacaatgggcggttttcccttcgtttctgacggaagcaggatatcgcactggcagaccgatgcacaccggttgcatccgatacagaggctttcatcgtaaatgatcggcctggcgctgctggctaccggcctcactgtaaattcaggctttttcatggctgacctcccccatataatcctggttgcgcagttcgtactcctcctgaagatttccgaagaaatcgagaggaacgcttcgctccctcacctggccgtcctcctggcggatgacgatatgacgccgttccccttccgggtccatctgcggataatcacttctttgaaagcacagcggctgcgaactggaccgccgccgcaggcaggcgtgaagcaccagctgggccacggtcagaatatccaggacctcatgggttctcatgaggtcgtgagggttggcgcacgacagagtgggaaccacctcccgctcatagctctccaaaaggtccagcccctcttttagaagctcctcacatttcacgccgccgcagtagttctgcattgccttggatatcgccatgttcagctctttccagttggttccatccttcacgtaaagaggcgcgtacagcctctctttttcccgatcggcctcttccctgctaaaatcctccaactcatgatccgaagcgcagtctgccgcctttcttcccgcgtaatatcccgtggcacaggcaaatcccgcgcagtcggaggcatacagctggtctccggccgcatagacgccatcgatgttcgtcattaagtcccagtcgtgcatgattccgcccggcgctccgaagaactggcgctcctgctccagaaagctggcggactgccagccggtgccgtagctctggagcatgtccttttccggatcaaatccccgttcggtataattttccagaatcggaattctggtcttcgcctcctcgccgaccatcattccccagataacgcggcgttcatcctccggcatacggctcaaatccgcatagaacgggagctggtatccccggcggatcagttcctcgaagtccagagtttccggcccccggtattcatacttcggattgtcgatgactccgccttttaggaagaatttctggccctgggccggatagtaccgctcggatactgttttcagttcctttccgtcacggtccacgtatggaatctccacgcctctggcatccaccatggtggccgcgtaccaggtattgtggttattgccggttccgtatgcggggaaacttcttcctgcacccgaaaattccgcgcgcaccgatttctccatcatggtaaattccactccggcccgccagcccatggcatggccgcttccgatgctctgcatgggacgaaattcgcataagcccaccagatccggattaaacagccagactctggccggcctggacatggtgagaatcgtggccttcgaccggaagatatagaattttcccgtatggacatccattccgcaggccccggctcccttcttctttccgtcctttaccgcagtaagcagggccgtagcctccgtcctctcatacaccttcacgcccagtctcttcagttcccgcgccagggcaggcttaaaggtggtcccccagacgcgcagggtaaatttgtttttatagtcataggcaaacatcagcttcgtcttctcatcccgaaactctgcgcccttaaattcatctccggtatccctcacctttccgccgaaagactccaggtccaggagccggtcgtatccctcacggcattcgatgtagtgggcgattccattgctgtaccagtcctgttcatggacgtaggcctccgcgatctcttcgggcgtcaccccggaacaggggttggtacaggctgattcccagtggtcaaaacccgttcctgcagaaccgcttcgttccacggcccccttttccaccagcaccacggatttcccttttctggccgcggctatggcggcaaagcagcctgccagcccgccgcccaggaccaggacatcgctggttacggtctcctcatccccaatctcattggcatagggccagctgtatgtttctgcactcattttactcctccattctgtccacgcatcccggacatgccgcaaagtgtcccgggctgacttcttcaagcataatctcgccggtcctgcattcctctttcacaaacgggcaccgcgccgcaaaccggcatccaggccccggattcaccggactggccacctctccctggagaagactcctcttcttgttcctcgattccgggctgggatcggggatcgccgccagaagggctctcgtatacggatggagcggcttcctgaaaagctcggccgacgatgcctgttccacgcatttcccccggtacatgaccatgatctcatcggatatgtgtttgaccacagacagatcgtgtgtaataaacagatacgtcagattcatgctgtcctgaaggtccatcaggagatttaaaatctgagcctgaatcgacacgtcgagggccgacaccggctcgtcgcatacgacaaaggccggttccataatcagcgcccggccaattccgattctctggcgccggcctccgtccagctcgtgcggataggcgcccgcaaggcgtctggccaggccgacggtctccatcatggcatccacccgcgcctcgatctccttcttatccttacagaccttattgacgatcaggggttccgcaatcagctgccggacattcatgcgcccgtttaagctggagtagggatcctgaaaaatcatctgcattctggggcgtatccgtttgaattccttctttcctacactctgaaggttcgttccctcaaacaggatctcgccgcccgtgggctcgtcaaggtataaaagcgtggaacccagcgtggattttccgcagccggattctcccacgactcccagcgtcgttccccgcttaacggaaaagctcacatcatccactgcgtgaagcagaccggagggcgttccaaaatatttttttaaatgttttacatccaacagcagatcttccatcactcctgccctcctttgttatcgcggtacagatggcagcggatcagatggccgttttcctcatatacggccggtgctgtcagactgcacggctccatgcacttcgtacaccggggcgagaatttgcagcccttcggcaggttcgtcggatccggcagaattccctcgatgggatgaaggcgcttcgtctcctccgtaaggctgggaatggatccaaacagcccttccgtatagggatggtgcctgccgccgttaaagatatcgctcagcgttccgtactccacaatctccccggcatagacgatggccactttgtcacacgtctccgcaaccacccccaaatcatgggtaatcatgattacgctggtttcgtattttctctgaaggtcacagatcatcgtcagtatctgcgcctgtatggtaacgtccagggcagtcgtcggttcatccgcgattaaaagctccggactcagaatcagggccatggcgatcaccacgcgctggcgcatgccgccggagaactgatggggataattggccttccgctctttcggaatacctaccatctccagagtgtcctccacccgcttttcaatctctttctttgacaggccgtcggtgttgtgaagctccagggcctcggcgatctggctgcccactgtgaggaccggatttaaggccgacatgggatcctgaaatatcatggatattctggctccccggattttctccatctcatgggcgctcagtttcccaagctccgtcccctcaaaccggatggctcctcccgtaatctttcctgtccgttccggcaaaagccccaggatggtcagcgccgtcgtcgtctttccggcccccgtctctcccaccagccccagagtctccccttttcccagggagaagctgattccgtttacggcgtgcaccgtctccatatccgtctcgtataccacggacagattctcgatctccagtatcgtttcactcattgcgccacctccttagtccttcagtttaggatccagggcgtcggtaagtccgtcccccaccagattaaacgccagggaagcgagcaggataaagacacccgggaaaaacagcagatacggtgaagtaaacatatacttctgagcaccggagagcagcgcgccccattccggagacggcggctggattcccatgccgataaagctcaagcctgcggccgataagatcatgccggaaatgctcatcgtcgtgtttacaatgatcggccccatggcgttgggcagcacgtatctgaaaataatgcgcgcattggaggtcccgtaggactttgccgcccggatgtaatcctgttcggccacagtcatgaccaccgaccggatcagtctgacattccccggaatacacgatatggtaattgcgataatcaggttctttaagttcgttcccagcgccgccaccacggccagagacatgagaatcggcggcacgcagataaacacgtccatgatgcggcagatggtattgtcgatcactccgccgaaatatcccgcgctggctcccagcacggcgccgatcaccagcgccattaagctggtggacacgccgatgaagagagaataccttgaaccgtgaaccacacgggcaaataagtcccggccgtattcatccgtcccgaagaaatgcgcggctcccggcatcagaagtcttgcacccccgtcctgttcgatgcatttggaataggggacaaggaggtcggcaaacacggcgatggcgacgatcaccaccaggataacgaggccgagcatggccgccttattcttcttaaaccggtaccagacttcgttccggatggcgttcttgcgtttctttcccttagccacggctctttcctccctcctggtatttggccttgattctcggatcgatgaaggcgtacaggacatcgaccagaagaatgataaggctgaataaaaatgccagaaacagggtggagcccatgaccacgggaatatccttctgccggatagcagtcgtgattaaggttcccatccccggcatggcaaacacggtctccgcaatgatcgcaccgcctaaggaggccccgaagctggtgcccagcgttgtgacgaccggcaggagagcatttctcagcgcatggcgcatgataatccgtttctcgcccgctcccttggccctggccgtccggatatactcctgcctcaccgtctcaagcatggcggatctggtgaggcggagcaggctggcggccgaccctaaggatatggttatggtaggcagaataaaatgcttcagagtgcctgcgccgtaggatggcagcagccccagatgcagggaaaataccagcatcagcatgagccccagccagaatcccggtatggaggcaaacaccagcgccacaatcacgcacgtatggtccagcacggaatactgtctcaccgcagagacaatcccaagcagtattccgataaaagcggaaagggacatggaaaatacggtcagaagcagtgtgttcgggaacctggcgacaatatcctgtatgaccggctgccggctctggtaggatactcccagattaaaatggaatacgatatccccgatgtagttaaaaaagcggatcagaaacggcttgtcatacccgaattccgcgttcagagccgcgatatcctctttcgacgccgtgattccgaggataatggaacctggatctcccggcgtcatagataagatggaaaatactaaaaatgcgactccgagcaaaacaggaatcatgtacagaagccgcttggccacgtatttggtcatggagaatgtcctcccttccacggattaaagccttaccaggcaaaatcatagatgtaatacactgcctcgtacggaatttccgggcatttcagtgaagagctgtatgcgaacagcgtaagcggattagccagcggaacgtagatggcttcctcctgcgctttcgtaaagatctggttaaagagctccgcgcgctcttccttgtcgttggaaacccgtgtcctgtcaaacagcgcatccatctccgcatccgaatatctggcattgttggcagttccgatgtaatcgctggcgaaggccatctccatcatctgggtatccccctccagcgtcatattcagtgcgctgatggtatagctgccgctggtcagatctccgatataagaattaaattcctttacggaaatcgtcgtctccagtccgactgcctttaaatcattctgaattacggtggcgagattggaatacttttcggccaccagcatttctcccagctgatacggcgtcgtgatgcctgcctcggccagaagggatttggccttctccggatcgtactcgtatttcggctgttcctcggagtagccgaaccggttggcggaacataagttggagtttaccgtggcctctccgtcatagcagatctgcaccagattctcgcggttgatggcatagtttaacgcctggcgcactctcacgtcatcaaatggtgccttatccaggttcatgcatacataggagaagctggaggttggaatctcagcgatggtgacatttttgtccgccttcagctgcggaaggctggccgagtcgatttccgcaaaatccacctcgcccgtctgaatggcgatcgccatggtagactggtccggaatgacctcgaaggtcacttttttaatcgccgcatccccgcggtagtagccgtcatacgcttccagcgttacactgcttcccttgcttcttcccgtaaatttgtacgggccgctgcccaccggcttattgacaaagtcgtcggccgatttttcataatacgcctcggaagcgatatggacggaacaggcccccagcaggaacggggagtacggattatccaggtggcagaccacggtgtggtcatctgcagcttccgcgctcgccagtcccgtaacctgggaattctggtactgggaatccttatacagattcagggaaaataccgcatcctttgccgtaaccggcgtgccgtcgtggaaggtggcgtcctcccgcagatgaaaggtgtaggtctttccatcctcgctcacctcatatgattccgcgagacgcggctccggatcgtgttcgccatccggattcatatacatcatcgtgtcatagagctggtttaaaaccgtaagctctgcggtagtggagtaatccgacggatgaagcgtgtcaatatcggcgcccatggccaccaccatatcggtatttccggagctggacgcacccgcgcccgtctccgatgactgactctgtgtatcgttctgtgtattgcctgcggttcctgaaccgccgcaggcggtaagcgacagcgccgtcaccgccgccagaataactgccataccctttttcataatcttgctcctctctctttaccaatggataaattcgatctcttctttcttcaggaaacccgcctcactgccgtaggccctgatggtctcctcatcgtataaattcgtaccctggaataccatgccgacttttctcacatttccgatatcggccagtggattcccgtccaacaccacgaaatcggcatccatgccttcccggatacttcccttcttctcttccaggccaatatgcgcggccggattgaccgtagccgccttcagagcctcgaaagccgtgcatccgtagagctccaccagcttctccagctcatctgccatggaaaagcccgggataattcccggataagcgcagtctgtgccggccatgaaccggtccgaatattccagaaaggttcgtcctctgccgatcaccacacggatatcggggcgaacgccctggctgcggtagctctcgatgattttcctgtttctgttctcccagctctcccgctcacattccgggagatctttaaaatgctccagctccggcagcattttaccgttccagacatagtccggcagcgtttcgcatacggcctgtgtgggagtaaaccacatcccggcttcggccagatagcggatatcggccttgtgggacggaagggagctgctgtgctcacagcagtaatagccggcgtctgccagcaccttgtcgtccagcttcttgctcatatggccgcatacgggaagcccctgctgtctcgctcgtttaagcagataccggtacagctccggctcaatggacggatacgtcttaagccataagaacccattccggatcgtatactcaatcgcctgctccacgtccgcctccgtgcggatgatctcattggaattgtccggtatactcggatcttctccgtcatagattggaccgctggaatagatataggggcctgtccgctttcctgccagcgtctccgcggcatattcagcgtggcgtttgtacccccgcatgtttctgacggaagtaacgccgcaggccaggaacatctttcccatataatcggcgtcgtagtggcagtggctgtcgatcagcccggggatcacgtaccggccgcttatatcgaggatctttgtttcaccgtttaatgcatctgcctcgcatctccaggcatctgcttcaccgtttaatccattcgcgggttccgccgcttcctgagctgcaaatgcagtcagattccggccgattttctgtattttcccgtccctgatcaggatatccgtatcgtattttatggtgcggtccctcatcgtcaggaggtttccatgtgtcaatatgtactgtttcacccggcgcctcccatcccactcagaagcggaattcatgctttgaaattgccgtacataatctcgctcccgcctcgatgtcatcctttgaggctacacagctctggcagtggggatatctggtcacgacggcgattccgcccgccctggctccgactccggacatattcatgctggacgcatccgttccgcccttgtcgatgacttcgggctgccatgcaatccgttcgcattcacagcattcctccatggctgcaaccacttcctcgtcgcagattaccgacggatccgcgtatttgatcgcaacgccctttcccacggtattgctgccttccagatcgcagggataatcgtgggccggtgtgatgtccaccgcaatgccgatatcaggacgaatccgctctgccgtcggcttcgaacctctgcatcccacttcttcctgcacggtaaacacataataaatatcgtttggatacgtgccgtcattctccttcagcgcctccagaagctggtagcagccgatccggtcatccagggatttggaacacaccagattgttctgcagatccacgtattctccgtaatagccgcagacggagccgactttaacgtattttaatgcgtcctccttagattttgctccgatatcgatatagagcttgcccacatcgttatgggcatcctcgatggctcccatacagccaaacacgccggttacgccgttgcggaaccgcactctggcgttgtaagccgaggccgcccagttccaccccacgttgcagacacgaagacggccgtcctcctcgatcttcttcaccatgaaaccgatttcgtccatatgggccgcaaacatgatcctcttcgactgcgggcctccctgtcctttcttaattactatcagattaccgatcgcatccgttatcatatcgtccgcataggctgcggcttccttctcaatcagctctctcacttctttttcatagccggcgattccctgggcctgggtcagccgtttcagtaattcctcgtttctcatatgtccttctcccgttttctgctttttcgctttaacgcgtcacataattattgttttaagaattgtaccatctatgattacattttgcaatatgcattttgcaaaatgtaaaataataaggttgacctactattttttctgttgtaatatgaatataaatgatggatatgagttttttaatgaggaaggatacggcatggatttaaataaaaccactctctccgggcaaatctacgatattctccgtcaggatattctgacacagagaatccggctcggcgagaaattaacgctaaaacacttacaggaacgcttcggagtcagctccaccccgatccgcgaggcgctgacccggcttgcggaggaagaactggtcgtctcctactccaacatcggcgtcaatgtcataagtatcggggaacaggacttgaaagagctctatgaattcatgggggatttagatgccctggccattctctatacctctcactatccggatcaggaaaaggtacagaaggcactggcggaaaatatacattatacggaaaaggttttagagacagaaagtctcacggaagaggaaatcaggacatggacaggctattccgatcattttcatctgatcttctacgattactgcgccaacagccgcctggcccgcgccgccgggaaacagaggagccagctgacgatcttctccaacatgtatgaggcgtcactgcagcaccaacgggaaatagaacgcggacatttaaagatttacggggcgtatttacagaaggattaccagctggccgcttcactgatgaaggaacatctgaatacttccctgtcttatgcgatggaatatttatttcaatgccactgcctataatttttgacgacgcctctcccaacctcaacaggcgggagaggcgtcgttattctttgcagaaaaagactgctctattatctctttaaattcctggatatcttcgtcctcaccgcttccgtcatgggcagtccggtatcgtagtccagctgtcttggctcatactcttcattttcccgctgtctggtatagccatcgttgctccaggtcggatccttgtccgtgcgccagcttctgcaggcccactgatatccacgataaaggtcgcgggtccggttcatctgctccagaattttgtcatgcagggaattgcggatttcggaatactcttcctcctggatccggttgcagatttctgccggatccttttccatatcgtacagctcatcactgtccagaagatggatcaccagcttataccgggcggaaatgacggcacgcatcatctgcagtccgccgaaaccgtcgtgatccgcttcataccgggtaaattctgtatagacctcatcattaatccggatatccgtgcagttgatctgaggcagcatgcttttcccctccagcatcttgggaatggggagacccatgtaatccagaatcgtgggagtcagatcaatgtgggaagccgggtaatccaccaccttgccggcctcgccgcccttgatgatcagcggaatattggcaacctccttgtagcaggcagcatttttagaagtaagccggtgatttcccagcatgtctccatgatcagaggtgtagatgaccatagcgtccggagccgtctcccggattttgtccaggacttttccgatttcataatctacaaacgagttgcatcctaaaaacagggacaattttccggaaggacagttgatttcctccctggttttgtgtaagttctcccctgcccataatcgctgcatcagtggtttttgacttaaatcgtcctcatagttgggactgtcctcaaaacagaatccgtcatacatggtattgtacggcgcaggacagagcgaaggaccgtgaggctcatcgtaagaaacggccaggaaaaaatcctcatctttatactcttccagaaagtctaccgcccttttggaacagcggtgagcgtatgtaaactcctctgtcatatcttcatcaaaggaggtggaggattttctggatttcagccgttcctcctccgtcagttcttccagataccggcgcatatcataccaatatgcctcatcccagccctccgggcagatgccattgccaaaatagtcaccgccgtctaaatgccatttgccgatataaccgcagtgaattccgttgtccgtcagacgctggcctacggtttttatattatctcccatggctacacagttcgtcacctccccattggtatgcggaaaggttccggtaaatatggcggaccgggccgggccgcagaccggctggcacgtataggcattctcgtaccggatgccttcggcggacagccggtccagattcggtgtgatcattttaggatttccatagcagcccagcatgtctttgcgcgtggtgtctgtcattataaggatgatttgttttttcatatgctattctccggtttctattatctgcaattgatcttttaacgccttttctgttttaggaaaggacgggcggataggggcgtccaggcaccagtctcccattttccacaaaaccttccctgcggttttccagggattctataagatgtccgcgaagctcctgaatccgcatcttacaggaatcttcctcaatcagatccgtaagttcatggggatctttttccagatggaagtactgctcctgaccggtctgtgaatgccagatgtatttgtctgtttcggtgacgatccagtggttggaatactcatcaaaggaatgctctccgtgaagccagggacgcacagcccgcgccggatcttcaagcaaaggaaggagcgatttgccgtccaccgtatccggaacaggggcgtctgccaaatcgagcagcgtgggcataatatcccgaagctccactacgctgctgcacctggaggaaccggcccctttcggcagaaacttctttcctcccgagatgataagcgggatgtggcagcttccctcgtaaggtctggctttacggaacatgtggtggtcacagagttcctccccgtggtctgaggtaaagataataatggaattatcgtaaagctcctgctccttcagagccagaatcagccgccctatctgatggtctaaatgggtgatgcaggcgtaatatcccacctgggcctgacgtatcagctctgcatcaatgggacccgtcttcgaatcatagatccgcccgtccctttttaacaattcgtccgtctcccaggtgcctacatacggtgggcgcagctcctgatcccggtataaatcaaagtaatgccggggcgcatcgaagggaggatgcggcctgagataagaggccataaggaaaaaaggcttccccggatcacgccgtctcaaaaagtctatgcttctctcggtaacccagttggtgggatggtatttttcctcatgcatccagggcctcgccacataactgttgcattcaatccccgtatctgtcacatcggcggaaattcccagctcatttttcagccagtagaaataatcgtcggctaccagctgggactcgcggtagggaatcgttgcccgcctggaatatcccagatatccgtcatgaagctccacatgatgaaagcccagataatttcttaaaggatggacatgcatcttgccgacgcattgagtgtaatagccggcctggcctaattctccagccagcgtatgctcatattcccaggggacgccatccagatagcctacacggccgtgatgattctgccccatccctgtatggatggcggctctggaagcgatgcagctcgggcaggcgctgtaggcgcggtcaaaggctgtaccggtggaggccagtgtatcaagatatggcgtttttacatcaggatgacctgcatatcccagacagtccccgcgaagctggtcggtcataagaaatataatattgggacggctcataagaaaactcctttgtttttttatcatcataatataataaaaattaaaaagcaagagtccacgcgaaaaattgtagtgcaaactgttgataaaaggcggcaaatgaagttttttattataaatatgctacaaaaaatagcaaaaaacataaaaaacaaaacaatatactgatagctaatgaatgctggatcagtatataatttacttatgaatttaagatatttcaaatgggcagtgcccaacaaaaaggaggatttatctatgaagaaaaaaccgattagcgttctgctggctgctgccatgacggcaggtcttttagcaggctgtggaagcaacaatgcaaaaccagcagagacaccagcagaaactccggcagcaacaactgccaaagccgagaccggcgaaacaactgcagcaccagccgcggctgagggagacaagaagtacgaaggtgttgaacttacatactggtccatgtggacaaacaatgagcctcagggacaggcacttcagcaggctgcagaggctttcgaggctgaaaccggagccaagattaagttcgagtggaaaggccgtgaaaccaagaacatcctctcttccgcactggaagctcaggaaaagttcgatatgtttgaagacgactacaccagaatctccaagaactatgtcaattatgttgctgatttgacagatatggcaaaggcagccggatacgctgacaagagctacgctgtattcaacaatcaggcgactgaatgggccggattccttccatgtattaccgagcagccatctgtaggcggcgtgttctataataaagatatctttgatgactgcggcatcactgctccggcaacatgggacgagttcatgactgcctgccagaccatgaaggacaaaggctatcagcctctggctctcgatagtacttatgccccattcctgtttggttaccatctgtcaagacatattggacaggcggctgttgaagatctggcaactaacggcggctggagcagcaatcctggcgtagtaaaagcaggccaggaaatgattgattttgtaaaagccggttatctggcagacggcgcacctgatgagtatccggcaagccagaacaagatcggtcttacacagaaaattgccatggtagtatgtgcaaactacatcactgcagaagttaatgccaatacaggcacagaactcaattgggggctgttcgcttatccggccgtagaaggcggcgtggacaataccagtacatttgcaggagcaaactccattggtattaccaaatacagtgagaatcctcaggcagcgtttgattttgctgtatacttaaccagcggcaagcagagccagaacatggctgatttgtccaataacatcccagcggatccgagcaatactccaccggctgttcagagcggaactaacgaagtattgatgaatactacagctcctctttcctggaatatgggtctgaacgctaacgcagataagatttccgttattcaggaagtaattgtaaaactgtatgaaggaagctatgcaacaggcgaagattttgcaaaggctctggacgctttatattaaagaatgctggaaaaccggaggtggcgcttatagcgtcacctcatttggtcagaaaggtgaaataagaaatgaaaaaaaacaaattgtttatcgttggttttataacaccttgtatacttgctttagttgtcatgtatttatacccggttgtcagaaccgtaatcatgagtttttttaagattgaaagcgtgacctccagtgcttctgaatggagttttaacggtctggctaattatgcaaaggtattttccagtcccacctttcagagagcggcgacaaacattctgattatctggttactgggaggcattattatcctcagtttttcactgctgttttctgttatcatcaccagtggaatccggtttaaaaaatttttccgtgcagcgatttatcttcccaatattatcagcgccgtggctctggctaccatgtggattcagtatatctacaatcaggattacggtctcattaaccagattttaaggacgatggggctggaggggaagaactggctgggaaccgacatgaaattctgggccatgctggctgccttcacatttggcgcggtaggctactatatgctgattttcatcaacggcatcgaacagattccctcagatatctatgaagctgccacgattgacggggctaacaaagttcagcagtttggccggattaccatgcctttgctccgcggcatttttaaaactaacatcacattctggagtgtaaactgtgttaccttttacttatggtccaagatgttttcaccggtcagcacggaagcttccacaattacaccggtggtatacttatatgatacggtatttggtacagtcggcaatgttcagcgagatgcaggcgccggtgctaccatcggcgttgtcatggcaatctttattggaattgtttatttcattatgaacaggctgcttaaagatgatgatcttgaatattaatgtgtgagaaacgtggcgcaagaaagatacttatctgacatgtccacagaatggagtgaaaaatgagaaaaaggaacaaagaaaacgtgtttaggagcaaggtgaactggagaaaagagctgacccttcttccgggatatctcattctgaccatttgggttgcctttacagcggccttcctgatctggattctgggtgccagcctttccacctccagagaaatcttcaccggcacggtatttaagtttgaatcaggagttcactttgaaaactatgccagcgcgtggaagggcaacaatgtttctgtttattttgcaaactctctgctttatgcggtatcttcctgtatcgtggttatattgatctcagctccggccgcgtatgtgctttcgcgctttacattccttggaaataaaggagtcaagacaggtttgatcctggccatgagtatcccggaggttatgattatcatgccgatctattcactgacggcccagtatcacatccggggaagaattttactgattattctttatatccttttacgtgtaccctttaccactacttatctgctgaacttctttgccagtttgtcaagaagttatgaagaagcagcagcgattgacggctgtacacccgccaagaccttttggaagatcatgttcccactgatccagccggctatcgttacggttaccatctttaactttatgagtgtttggaacgagttcttcatggctcttatctttgcaacgtctacggagaccactcctgtcggcgtaggactgctccaaattgtaaatgcaatgaagtacaccggagattacggcggattgtttgcggcagtaattatcgtcttcctgcccaccttcctgttgtatgtcatcctctccgaaaagattattgccggtgttacaggcggcggtgtgaaaggctaaaaatattaacttgacagcaaaggagaacaataatgaaaaaggattttattggaagagttacaatacccacagacgtggacgtagttccggagacgctggaactgctgaaacgctggggcgccgacgccattcgggactgtgatggtaccgattatccggaggaattaaagaatgtggatgccaaagtctattccacctactacaccaccaggaaggacaatgcctgggctaaggccaatcccgacgagattcagcagatgtatatcatgacaccgttctatacggcagtaaaggatgagctgtctattcatcttatgaaccatttacatacagatttattgaaagtgaacgacagggacgatatcaggcgttggtgggaagtcatagacagaaccaccggtcagcctgttccggtatcttcctgggagtacagcagccagaccggggatgtgatcatccacggatcaaaagaattccatgactatacggtaagcttcctggcttacatcatgtgggatccggtgcacatgtacaatgcagtcaccaacggctggactgattttgaaaagcagatcacctttgatgtacgtcagcctaagacacacaagttttccatggacaggctcaggaagtatctggaggccaatcctcatgtggatgtaatccgctataccacattcttccaccagttcactctgatcttcgatgaactggcaagagaaaaatacgtagactggtacggctattcggcatcggtaagtccctatatcttagaacagttcgagaaggaggtcggctatccgttccgccctgagttcatcatcgaccagggctatatgaacaacaactaccggattccttccaaagagttcctggatttccaggctttccagagacgtgaggtagccaagctggctaaggaaatggttgatatcactcacgaatacggcaaagaggccatgatgttcttaggagaccactggattggaacagaacctttcatggatgagtttaagaccattggcctcgatgccgtggtgggaagcgtaggaaacggctgcacgctccgtctcatcagcgatatcgaaggagtcgcctacacagaaggacgcctcctcccctacttcttcccagacaccttccatgagggcggagaccctgtgaaggaagcaaagattaactgggtaactgccagaagggccatcctgagaaagcccattgaccggatcggatatggcggctatttaaagctggccttacagttcccggaatttatcagctatgtggaggacgtatgcagcgaattccgcaccctgtatgacaatattaaaggcacgaccccttactgcataaagacagtagccgtgctgaactgctggggcaaggcccgtgcatggggcaatcacatggttcaccatgccatttatcataagcagaactattcctatgcagggattatcgaggctctgagcggagcgccatttgatgtgaagttcatcagctttgacgatatcagggaaaaccctgagattttaaatgacatcgacgtgatactcaatgtgggcgatggcgacaccgcttacactggcggagacaattggacggatgagaccattataaccgcggtaaaaagattcatctacaacggcggcggatttatcggagtcggtgaaccggctgctcatcagcatgagggccatttcttccagctggctacggttatgggagtggaaaaggaaaccggcttcacgctcaacgtggacaaatacaactgggatcagcatgaccactttatcaaagaggactgcaccagagacatcgattttggggagggcaagaaaaacatctatgctcttgacggaacccggattctggttcagagagacaaggaagtacagatggcagtgaatgagttcggacagggacgatgcgtctacatcagcggacttccctacagctttgaaaacagccgcattctgtaccgctccatcatctggtcctcccacgatgaagacaacctttaccgctggttcagttccaactttaacgcagaggtacacgcctacgttaaaaatggaaaatactgtgttgtcaacaacacctatgaaccgcagcataccacgatttataaaggtgacggttccagcttcgaactggacctggaggccaatgaaattatctggtatgagatctaatcgtctggatcagacgaaatacgcagcttattgaaacaaagtaaaaataacaaattcccaggcagactgctctggggatttgttattttgcgttgttatttatatctcgtcagactctccattcactgacacctgttccgttttgaaggaattgagatagacagtaattttttctttatgtgtcaataccatggtatcctctaaaccacacccttttgcagcagaatattcgcatataacgccttctctcccgtagcgataaccacataggccttcttcgcttcctcataaaatgcaaaccgctcgatatggcctattgcactgctctccagtccgctgcgccgcttcacgatttcctcatacgtatcccatatgggagtttcagccgtatctccgctcataacttccatcagactgaccggctggctgatataggagtccaatgggaatagctccaatacagcctccagcacttctggggcggagtgtccatccatgcggatcacgatcccgccccttcctatggattccgacgggaaattaccgtcagcgattacgagggtgtcactgtgccccatctcgcataatactttgagaagctgcggggacaggattgacggtattcctttcagcatagtcctgctctcctcactttccgtatttcctgtagccgggatgtcttccagtcacctgatagccttcccgcatggaaatcaggcggtcaatattctctcttgatatctcttttgcccctcccagcagatgagcgttgagactgatttttgcaaacagctccagcgtctccatccggtaatacgccgtgattaagtcggccccaacggtcaaagctccgtggttctgcagaaggagggcgtcatgttcccccagatacggagcaatccggtcgggtacttcgtaggtagaaggcgttccgtaaggcgtcacgggtatggagccaagcgcaattactgtctcaatcatggaatattcgtccagaggcttattggctacggcatacccggttgcaacaggcgggtgagcgtgaagaacggctcccacatcctcccgctctttataacagcgaagatgcatcttgatctccgaggacggtttcagtccggcggacgcatccaggatctggccgtcctgatcgatgtgtaccagtttttccggcgtgataaagctcttgctcatcccggtcggtgttgccagaaacgttccatccggcagttttaccgacacattgccgtcattggccgctacccagcccagctgccacattttatggcagatatcgcagatctgttctctcaattccatatacgttaattccatgttattacctccggattttaaagtatttccctgtatctttcataggcctcttcccagatttcccggtcgcgcggctcgtagacaacggtatgcagagtatccgccagcgcgcgtctcgcctgagcgaggccgtttaactctcccagtgccatgaactgagtcatggtatttccatagacggtagcctccaccggtcctgccactacaggcaggccgcaggcattggcagtcatctgacacagcagtccgctctgggcgccgccgccgatgagatgaatgaccgggtactgctttcccgtacatgctatgatctcgtccatggctttccggtatgcaagcgcaaggctctgatcgatgcagcagacgatttccccctcatactgcggaaccggctgccctgttttccggcagaactgccggattcgctcaggtatatcaccggatggaacaaattccggcgcgtccggattaatcaggctttttaaaggttccgtgcaggcggccttcgtctccagttctccaaatccgtattcctttccttcccgtatccactgtcttctgctctcctgaatcagccacagaccgatgatattctttaagaatgcgtatttgccttccagcccggcctcgttggtgatattaaatttctttgacatttcgctgatgaccggctccggaagctccgttccgaacagcccccacgttccacagctgataaacaggaaatcctcttcccgggccggaattgccgccatagcgctctgggtatcatggccagccacagcgatcacctccatggccggcaccccaagttctttttggatttccggacgcaggcttcccgttctgactgctccggggagtatgtcacgcatcattcctgcccggagtccaagcgtttccagcaatccgaaggcccactctccctgcctcatatccatcatctgggtggtagaggcaatggatttttcactgattttctctccggataagaaatactggaacaggtccggcatcagaaggagggcgtctgccctttcgagaagctccggcctccgttcctttacagccatcagctgaaagagcgtgttgatctccatcagctgattcccggtcagttcatagagagggtctctgccgaccattttcagtgtcttttccatcattccggctgtccgcccatcccggtagtgaaccggattgtccagcagccttccctcccggtccagcagaccgaaatcaacgccccaggtatccacgccgataccggaaatcgctccgtgcgcctttgactttacgattccctgtttcatctcgaagaagagacggagcacatcccagtacatggtatctcccagtttcaccggatcattggggaaacggtggagctcggaaatggtcaaggatgccccgtcaaacccgcccagcatcacacggccgccggaagctccgtaatcaactgccagtacctgcttttcactcatactgccaccgccttaccggtacacaggcccgaacgcggcgcacgcacggtaatcctggccctccggatccatgccaaaggcattccatgcggccgggcggaagatcttctcctccggtacattgtgcatgctcacgggtattctgagcatggaacacatagtgatcaaatcggcgccgatatggccgtagctgatggcgccatgattggctccccagtgattcatcacgtcgtacgcggtggcaaatgctccctttcccgtcactctcggtgcaaaccaggtacacggccacgtataatcggttcgtttccagagtgtatcgctcacttcttccggcagctttacggtccagccctccgcgatttgaaggacaggtcccagtcccttcacaagatttaaacgaatcatggttaccggcatctcacagtcggtcaaatatctggatgaaaatccgcctccccggaaatatccgaaatctgcttcattccaggtcgtggctgccatgatggccctctgatcctcttccgtcacctcataccacggcttcatcacggagtttccgtcagcgtccttcgcgcctccattggcatcgaggcacgccgcgccggaattaatcagatgaaggaacccatccgccgccttcgcccgtccttccagctcatagcctgccgcacgttttaccgcgtcgccgctccagtaggtccggacatcggcaaatatctgtgctctgcctgtcagcagtttcatgaacatcatgccaaggccgtttaagacatcattttccgttgccagtatgtaaggctctctcgctccgttccagtcgaaggaggtattcagcattgcctccgggaagtcacagttagggtagaaatcggtccactggcgctgtccctggaaaccggcggcaatggcgttatggcccaccttttcctcctcacagccttccggaaggttctggtttccattcatcaaatctttgatgatgcacatcattttcgctaagaattcccagtccttatccttctgttcgcggctctttctcacttcttccggattcttgtcaaagccttccatacaatacttcttcgtccaggccagagccttttcatattctgcatgatcgtagatttcctctgacattctgcggatgatctccacctcatcgaccgactccacgcgcatgcctaaatattcttcaataaaagcagggtcaatgatggacccgccgattcccatacagatggatccgatctggagatacgattttcccctcatggtcgccaccgccaccgcggcacggccgaaacgaagcagcttctccttcacatcctccggaatctccatatcatctgcttcctgtacgtcgtggccatagattccgaacgcgggaagccctttctgcgcatgggtggccaggacagaagccagataaaccgcgcccggacgttctgtcccgttgaatccccagactcccttgatggtcatcggatccatgtccatcgtctccgccccatagcaccagcatggagtcactgtcagggtgatatccacgccttctctgcggaacttatcggcgcaggccgccgtttcccccactcttccgatggtcgtatccgcgatcaccaccttcaccggctcgccgttggaatagcgtaaatgtttctcgaaaagctctgcggccgccttcgccatattcatggtttgatcctctaaagactcccgcacctttaaataccctcttctcccgtcaatggtcggtctgatcccgatcaccggataacttcccactaatctgctctctgccatgttacattcctccttggaaaatcgtttattcttatgagatcatagtaccatctcttcgacgtattttcttgtcttatcatggcaaataattggacgatattccgattcatccattgcgcaatccgcacctgtaccgtataattggaaattatatagaataaaattcatgtttggagttggtgattttagatatgcattatataaaatataaagaaatgaaacatcatggaactgcagattttccggcaggctattaccatgtcacggaaagtcatccgcagtatgccatgccctaccactggcacgaggagctggagctgattcatatcgtaagcggtacgttccacgtgacgatcaatgaaaccacacggactgcggccgccggcgacattctgcttgtcaacagcggcgggcttcacggcggaacgccctatgactgcgtctacgaatgccttgtatttcctgtcggcctccttttcagtcagacctttgactctgactttttaaagcggctggacagacaggatttgatcctggacgaatattttccgactggggaagatactgcgattcacagtctgcttaagcgcctctttgcgctcatgcagaattcggaggagggaggaaagctgcagtgcctgggactgctctaccagcttatgggactgctctgcctgaataagcggtataccgtctctgacaaatcggacttatccagccacaggaatctctatcttctaaaaaatgtactgaactacatcgatgcccattataccgagaagatcaccttaaatgaactggcccgcacggccgggatgtcaccgaaatacttctgccatttcttctccgaaatgaccgggcggacgcccatcgattacgtcaattactaccggattgagagggcctgctgcctgctggcgggcacagacagccagatcacggatatcgccatgctctgcggctttaacgatgtcagttatttcacccgggcgtttaaaaaatataagggaaaatcaccggggcagtatttaaaggctccgctgtaataaactttattcacgcagagcgcatgtatcaatatctgttaccggtttcttctcctgtccactgtccggtttaatttctccgacatcacaaacagaagaaccgtcaggatgagtatgtaatacggaaaactgctgatattgatgctggaggccataaagccgaacaggggcggcataaatgtcgttccgatataggcgctggccatctgtacgcctataatggactgggagttttcccttccaaaattatagggtgttgcatggataatcgcgggatatacaggggcgcagccgaaaccgaccacaaccagaccggcaagaaccagcatattggtttttaccggagccgccacaagaatcagtcccaccacgatcgtcgcgataccgatacggaccagcccgcggtctcccagccagtcggctgcaaaaccgcctaaaaagcgtccaaatgtaataccgaaaaagaacagggcggaatatcctgccgccagattcacgtcgattccccgatgctgcaccatgtagctgctcgcccagagcatcgtcgtctgttccaaagcgcagtaagaaaagaatgccgccatcaccagcggaacacccttgattttcatggtctgaaggaggccgagagccttcacagggccattctctgtgccttcttcctgtgtacggcttttctttcccccattcacctgtttccagagcggcaggctgatgaaaagtccggctgtcagaacaaactgtatgatggaaaccgtgcggtacccgctgtgccagccatagcctcctgtcaggcaatatcgcatgatatagggactggcagcggcgccgagtccccagaagcagtgaagccagctcatgtggcgggaagcatagtgcagagccacgtagttattaagcgccgcatcgaccgctcccgcgccaaggccataagggacggcccacaggcacaacaggacaaaggaaccggatacggaaaatccgaataatgcgactgccgtcatgaatacgctgacggcggtcaccagaccagccccaaacctcttcgtgagacggtcagaaagaaggctggaaacaacggtgccagccgcaattaccatggtgatcatacccgcataggaaaccggcacattcagctccgtatgcatcacaggccaggcggaacctaccagtgagtccggcagtcccagactgataaaagccatataaatgataacaagcaaaaatgaatacataatcttctcctcgccctttcttttaccggcgcgtaacggcggaaaccaattccggcagtatttccgccgcgccctatttcttcaatcccatgcattttcccagaatctccagcatctgatccacctggatcggctttgagagatggccgttcatgccgctggccagcgattttctcgtatcctcgtcgaatgcgttggccgtcagggcgataatgggaattctgcgggcatccgggcggcccgaggttcggatacgcctggctgactccagtccatccatgaccggcatacggatatccatcagaatcacgtcaaaccagccgggttcttcgccgcagtagagatccaacgcttcctgaccatcggccgcacaggccacggtgaagccgttcatctccagaatcgtctgcgctatctcccggttcagatcattgtcctcggccagaagaacacgactgccatggaaatcaggaatgtccacgttctgttcctgcacagggatctcctccgcatcttcacaggcatattccaggctcagggtaaagaagaactccgatcccgttcccggttcgctgcgtacttccagagtaccgcccatcatctgcaccaggcggctggatatggacagtcccagtcccgttcctccatggcgggaggcggtaagcgcagccgcctgctcgaaggcattgaagattcttctcatggcagccggttcgatgccgattcccgtatccgtgacagaaaaacgaatcagcgctctgggctcttcctccagcaccttgacccggaccgcaacgctgccaagctccgtaaatttgatggcatttccaataatattgaccagaatctggttaagccgcaggctgtctgcccggagcagccgtcttttcctgtagtcattttcaaaggtcagctccagatgcttctcctcggcctgggcgcggaataaggattccagattggagagctgctgttccaaatctatggattcatagcttagctccatcttaccgctctcgatccgcgacatatcgagaatatcattaatcagccccagcagataggtgttggccgactcgatcttctctaaacagtccagtgctttctcacggtcatccagcacactcttggcgataatcgtcatgccactgatagcattcatcggagtgcggatttcgtgggacatacgggacaggaaatctgtttttgcctggctcaccgcgtcggctttggatttcatgataaaagagggaataattttcaccagctcttttaaaagcttcctctgttcccgggtccactgatagttttcctgatcgacctcaaagctcatggaccccacgtactccccatagttccagatcgcggcatgaaggcaggaggcgatatgggagattccgtctctcacattgtgatcggccaggccatcctcgtcatacatgttggcgcagatttcaaaatcctcctccgaggcatagaaatcctgccccagctgcagatccgagtggtggcgcgcccactggtaggaaaaatggtaggacaaaaaggctttatccgcctcaataatcgatacccggtcgaaatggtagttctttccgatacgggatagcagcagaaacacggcgtcgttgatattcttcgaccgccccagcagttccagcgcgaaggaaacgagatccttctccggatgcagaatctcccggtcaaccgtgtttacctggaactcatccggatacatctgtgtaagcagcacgcccacctctctggaggtatccagataacaggcggcgttacccctgccgtgatccttgacgtatttcaatgtgctctcggcacagcagtacagcgcgttatattcgtccgtcacttcggtgctgcacataccgatgctggccgcaatccgaatatccttttccgtgttgaggatgatattccgtatcatggcagcgatgcgcggcccgatgatcccggcctcctgtttgttgcagtttttcaggaaaagcataaactcatctccgcccaggcggaccttaatgctctccttttccgtcacctgccgcagaacatccgccacctcctgcagaaccgcatccgcgaagatattgccctccttctgattaatatcctcaaaatcatccatatccagaagcatcataacgccatgatcccccggctctcttcctgaggccaggtactcctgaatcagacggatcccgctctctttattatagagtccggtcaggctgtcgcgggatctggcttctttcagcgccgtctccatctccttctcacgggtaatgtcctccacaatcccaatgacaaactgcggatttccttcttcatcgctgagtatcacagacatggtctcgcggctccaataacggctgtccttcccgcggaattcgcaggtagccgtccgttctccgcggtgaatctgatcgtacatcgcatagaaggctggataatacgcttcatccacctgttcctctgcaaaactgtacggcatattttcataccggctccgacagtggtatgcctcgcaagtccgctccggaacctgacactcacaggtctgcggatagtaataaaattcacaggtcgtggtatgctcaagagccagatgtatgatctcattgctcgcctctacctgtctggtcagacgcagttcattcagttccgccctcttccgggcgttgatatcgataaatacgctctggataaactgctctccgccgctgtcctgaaggacttccgcgctgccgatgatccagcatgggattccatccttctgaagcagtcggtactcaaaatcggacttatcaccggtctcatgcagcgtatcgatctcttttaatacggtctcccggtcttcctccatgatcagcatcggcagatcccaatcctttttttgccagaactcctccggttcatagccgaatatgcggatcgcctcccggttggcatttttaaattcaacgcccataccggtcaaacggtactgcacaatgccgcaaagcacggactgaaaaagatggtcatactggttcacctgccgctcccgctccagttcataccggtccagcatggatttcggaaaatacccgccttcttcctgctgcctttcgggtgtcgatgcgtgaatcgatgcgattctgcatatcccatcctcttccttgacacaggcggcgctcacccgaaaccaaatcccgggttcttcactccccggcggatatacatcagccgtgagaagcacgacggcacaccggtcggaaacaaccgtctcgtcgaagctgtcatactctattttcatcggttccggcgccagggaaaattccgtaagcagcgcctgttccgtctggtcccgtccctttgacagttcagactttccagttcccacccaatgcacggtatctgtcacacaatccagcgtgtccttcacattccgccggatcagatacgcatcaaaaaaagaacggaccgttctgccagcctcgcccggttgtatcataattccacctctttctgtactttatctatataaatacaaaattgtatcacattctgactgttcgtttgttctgattattcttaaattataaagcagatcggggaaaaactcaatcgaataagtcagatagattacagccgccgcgcaatctccctcatatgtctcccatccgtcccacagcccccgccatatatcttcagactacaaatttcctcacatgattatacacggaaacgccccttcggacagcctgtaacctcacacagcttccccgcataatttatacagaggaggagacaccatgaaaaaactacttttttgcagaaaatgcctctgtgcggcactcaacaggattcctctggtcgataaatgccttcttgtatttttccttgtactgctgactcagtctgcatacagcctgttttcacacaacggaaccggttcggaaattgagcatatcgatgtgattgtgcggacatcctctgccgccatattcggctatatcttaagcgccaactttatcctgcaggccgaggggaaatcaaggcagaccaagatcaggccagaacacccggataacggagacgaacacttttcttcacagagcgtcccctcctacgattccgcagaggatgcaggccccggttttgaactggaaaaagaactggttgaaaccgaaaacaccgaaaatgacgattcagaatccctcccggcaaaatttctgaccggcaggctgcaaatcctgattgccacattcatcggattattctgcctgattaccctgatccttctgcgcaatgtcaacgcccttaactccgacctgctgtcttcctcttcggtgacagctacaacagcacagttcagggatttcgtatcgggatgtgtgggatttttaatcggatgccccacggagaaacagagttaaacagagttcataaaaaaaggtacggctggcagacccatgaaagtctgtcagccgtacattttcttatgcatacttatccgtatttcggactctgaagctcaagcgcaccccggaacgcgtagattctgcagtcctgaaaccgcagagatatcaggacagggcgctgtccccaatcctgaatattccgatttttaaagtgaatcttataatatccgccctcacccggcagtatctcgcattccgcatatccaaagccttcgattggccggttccattttgtgcataaggcggcctccagatatccctgctcccccatttccgctagcacttctatgtcttccccgaaaaagcgaaaggcggcagtcgttagcaggccgcgcttctcacggtccacagccgtataaaaggccagtttatcctgctcaaacgacgctctccccagagagctttcgcggaaatcggaatgctgtccatttccacccatgtaatacacccacatctggccatcgatttctacaggtgccgaagcgaagatacatccacagtcgaattcttctgaatagcgcccctttcctcttcgaatcacagggcttccgggacagacccagtcaaaatgttccggctccgcagcaaaagccagctcgcagtccaccgtgtcaaaatcgtcggacgaccggtcaccctcatgaaacacggatggaagtcccagatacagcccctcatactgaaataccggcatggagtaaacctgagcggaaaagcgccgccccctcaatatctccacaggctcactccacctgataaaatcacggctctcactcatgactgaaattctgaccccatttttccaggttctggtgatcagcctgaatgtcccgtccctcttatcccggaacacaaagttatgggaatcagccctcggattgtgctccggccatggaaccatctcgccccagtgaatcccgtcctccgaaaaattcaccgccataaagccggattcatccggcccttccaccttcgttaccagcttatacctttttttcgggtcttcctctctctcatccagaaatacccccgttccgtgcgcatgcagaaacaacagattattctccgtatttccttcaaaggaaaccagccccagcgccggtttataccacattacaccgtctctgctctccgcgtatgcaagagatgtgatgcgcccgggaagaggctcataatgggttatcttacgctctgagagaggagtatttgccgacgccggatcgtacgtacacagggtatagtaacaccggtaaatgcgttccgccggatcgtagatgacattcggatacccgttatcaattctcacttcccaccttctcgccggctcccgaaagtagtcttccgtaaagaatggagtgtgcatgatatccttcttcatctcacagatctccagacggacattatcaagtccctgcggagtcagtgttccgctgtccagcagcaaatatttgttcatttccagtctccttcatctcttgccggcactctgcctgcggctgccggtcttatctattatctcaatttctttttcataatgtacattgcctttataccagccaggcgcattaagatactcttcttcaggctttctgttctgtaccccatcttctcgtagagtgagacagccggcagattgtccttcagcacgtcgagatacagctcatcaaaatccaaaccggcctcggcaaacgttaaaagctgccctcccactcctttcctcctgtattccggtgaggtcgctataaaatcaacgtatccgcttcggtcccccttcacagcgggtatgctaagcattttgcccagctgccacgcaagtatcttcccttttaccggaccaaatacagagacacacgtctcctcattcatcacgatggcccttctcctggaatccgagactgcgatcaggccggctacccggtcctcctttaagagcacgtaaatcagatccagctgcatacagggtgtaaaaagtctctgcagaagctcccgttccttcgttattcccttaaacatggagtaaaaactgtccactaacagcgcggctgtctgctgaacatgactcgcctccagctggtttaagcaccttatctctgtattttccatactacgcggtcccctccgtcccttttaatatgctgacgatccattctgcctgcggaaacggagtctgcggatatacagcaagctgttccgcgattccctggatgctgcaccagaacgcgcaggccagcgcctcaggattccctctgcggatctctcccgcctcctgccccttccggatcagctccacggttttggcataacgggtctcctgggacgccagaatctgcgtgatccgttccggtgccgttctgcttctcagcgcctgtgcgatcaatacaaagaattccgccccctgcggattcacgcgaatcatatccaggatctgatttgtcacatttgtaaaaaagttcagcggcgagcgctcatcggtctccatccacgcctgggaggattctgtcccgatgcggataagctcctcgtacaggctctctttcgtcgcaaaataatgaaacaaaaggccgtcgctcatatttaccgcctttgcgatatcgctggtcttcgtcgccgcataccccttttttacaaacagatccaggcctgcaagtaaaatttcttcgcgccgtttctctttttgctggtcacgtgtattcataaacgggatcctcctgttcacttattacgtttctattcattaagtttgtattcattgagtgtttacttaatcagtttaatagaagtcataccgaatgtcaaggaaaatcaccgtttttgcattcatagctttcacatacggttaaatcgtctctgctttttcacttacagagtatcccatctggtaaaatgccaggctgaacaccaatatgatgcacaggacggcgaacatcgtggaggcagtcgcctccttcagcaaatatccgcacagggccggtgatatggacagtcccagaacgatcatattctgtgcgccgaggtatacacctctctgctcttttggagtaatctttataataaataagtactccgccggtacaatggccacttcgccaaaggacagcaacacgatcgccgcagtaagccacagcaggtccgaccgaaagattaaaattatcaggcctgccatcatggatccgacagcgaacctcacccatctcatgattgttttcttcctgataagtgcgctcacaaagtactgcagccccatcacaattgcagcattcagcgccgaaatataggccactctttgatacgcctcatcatagggcaatacggaagaaaagaacaatgacataaatgtaaccagtgctccgtatatcatcatggacagcacgccgccaattgtaaaataaagcagccgcttatcctgtaccagcagcctcatggtctgcccgattcccaaatcttccgttttgcccacatcaattttcccattgaccggactgctcaccagcgcctttgaatagacaaagaaaatgagcgttatcaaaaccaggcttgcggatgccacataaaacggaaagcgaagattaagcttcaccagcaccgtacccagtacaggccccaccatagcgccaatgttctccagtatatatttaatggaaaatgctttcgtactttcctcctctgacagcattatggaaaaccaggcattggtaacaatcgccagagatgaggacgcaatattaatcaccatcaatacgccaagaataaggaatccatttgacattcccagaaagattaagtaactgactgccatcacagaaagtgacaacgcaaaaatctttttcttatcacggcggtctatgagaaatccgcaaaaaatgctcataatcgtccccgataagctgcccagtccgatcagatatccgctgttctctacgctgattccgagacgttttcccagatacatgggcaaatagggcgtcagcgcccagtaagccactgctttaaaaaatgcacacaaaataattacacagactgcccttggaaatttcggcagtattcttccagttactttcattttccctctttcctgcagcctttccgtgaattctgaataacagtgaaacccatcattcagcgccatgtttttagcattaaaaaaagtgcttttgacaaatcaaaagcacccactgatcgactataagagaaaggctacagaaaactcccgatcgtaaacagcatgactttttgatttatcaataatctcttattcgtcatgatattcaccacccttcctgatttttttaagtataccataaagaccactgcccgtaaagcaattcttattcgccgcaaacgattaattttgtaatcccgttccgatccatgtatacttcctggtctccgcccagcatacctttggaataaaacaataccatccacatctcacccgggatatcatcataaacctctgtatctgtatacaaaatcgtgcattcctgtttcgcccggtttacaacggattcttcatcaaccaattacactggatccgtatttctgaaatcactgcaccggattcctcccgattcttccctgtatctcagaagaacctcctcataggaaaaatagccttttccagccgccctctgcgtgtcacagacaaaacgaagacagtcctggacaccggttttatcgatcatttccagggcctcaatccggttgggccgctctgcaacgatacagggatatggccccttcagccacggaagcgccgatgctttcggctgaaagacttttctgatctccgtcagtccctccacctttttatccggcagacgaaccagcagcactttgccggtcagattgtctgcggggtccgttttctttcctaagaaggcaaacatctccgcctcactgagcgtatattcacacggttcttcctgatcggtcaatccttcccactcatccatttccatctccgttcccccatttttcaacgccagatccccctctagctccggtcatctcccgttattttcatcaggtcagatattgataatccgaataatccacgatcccctttatcgttttcagagaaccttccgctaattcctttaccatcagacactccggtgcaggaagctgaagccctggaccggcaaaaatcccatggttgcttgcttcttatttcctccaccagccttctcaccgtattccctgactctgcattttccgattccgtaaagacccgttccactaaatccagtgattttgtcaggtatttctcgtccatacatttcattttccagctcatgaaacctccaattttctcaaaatatccttcgtcagaagttaggatcatcggctacgagtctgcattgatggcagacaaaatcataccgtatcttgcgggatatcgcatgcttctgattagcccacggttccccgcactttgggcagaccggtttattttttttgtaataagtaaacagaaaataataaaatggctttctcgtcctttcttccatgatactgcagtattgaagcgcttccttcgataaaaggctgttcgggtcgtgcatcattttatagccatgccgctctccgattccttcaaaaaattgccggtcacaggcccggtaagctttttgccagcctaacaggtcgaaatactccgtgccgtcataggttttcggaaacttgtagagcggtaccgggcatttacaatcaccgcagataatcggagatgccgcccacagacactccgaaaacaggatataatggctgggagcttcacacgtacagctgtcctccacatcgtaattttctccgatatagagcagctccggcggctttgcagagtctttgcatacatcctcaaaaaactcccgggtataccggtttccatacttttcactcagagaatcccgttccggcgctacgattctgcaggcaaaatattctgcgcatttgactgtattttgaaattcagacagaatctggccattcttatacagacaggatataaaccactgcatattgtcaataaacacatcgagttcctccggttcgaatgaccggggataaaagcggtattcatatgtatacattaggatacctcccttttatattaaaattttctcatgatcaaaacacgtttctgctctgcagaagttccttcagaaccaccatctcaccggccgtcaccgtcacgccttttccatacgccgtatggtcctcgttccacgttctgatatcatagacgggttcccggtcatcccagctgatataattcagttcttttgtccagccgttattaggcctggagatgggtccaatctgtttataaatgtcaaacttttgcaatccattttcctcctttgccgttatcgcagcgcctccctctagtcctattttcttatcgatcccatccatcttatgctcctgtcgtgcctgtttgcagctgctgcgtgatactcgagctttaattacattaagtatatcacaagccagaccattttgtgcaagttactttactgctttatcagaggcggcactgccagacaatctcatttggctcacagagaatctgcaaacaggcaatgaagactggacagaaatcggttatagattcctggcccgtcttcattgcctgctaatgtgcgcctctcaatacccccctaaaaaccgaatcaccggagcgacccggctctccagaatctccacccgaatttcattcgttgtcacaggctcaaacaccgcgttcttccggcagccaaccgtcttcccctcgcagagcacctgacgctcttcgccgcagacgctggttatccggtatttttcaattctctggctgaaccggatgtcctccttgatcactaccatggatactttaaccggctcctcccaggtcagacggatctcacagcttcggataccatcgggagtcttataacttccctcatcatctgaccgaagatttgccgcgtcgtgacctggctcagacccggtggcagtcatctccgcttcctccaccagattatgggcctcgcgccgtcttaaatacgcccccagttctctcagcctctcggcatcgcgatcatggatcagcccctccttagtcggcgggacattcagcagcatcgtgctgttgccgcccacggagcggtcgtagatggataccagattctccaggctcctcacctgatcgtcctcggactcatgatagaaccagcccggtcttatggagaaattcacctcggtgggataccagaccagttcgttttctccctccagcactgcccggcttccaagatcctggtcactgctcgaaagggttctctgccgaaactccgtctcatcactctgctggctgttttccctgattttttctgtgtcctggagccgtccgggcaccacgctccactcctgctccctggtgtctccggcttcgttgccgcaccagcggacatcggggccgcagacggagatacaggcttccggctgcagacgtctgattacctcatagtaccgctcccagtcgtagctctgcacgtttccatcaggcccctcgccacaggcgccgtcaaaccagacacagaatatatcgccgtatcctgtcagcagctccgtcagctgtcccacaaaaaaatcgtcgtattgggttccttttccatagcatggttcgtgacggtcccagggcgataaatagataccaaactttaaattgtatttccgaagggcctccgacacctcccgcaccacgtcgccgtttccgccccgaaacgggctggcggctaccgtatgagccgtataccggctgggccagagacagaagccatcgtggtgcttgcaggtgagaatcgcgcctctcataccggaagccgccagagtctccgcccactgctccgcatcaaaatgctccggacaaaaaacagagggggattctgtgccatccccccactccctgtccgtaaaagtatttacggtaaaatggagaaaaccgtaaaattccagcttctggtgacgcatctgccgctcggaaggcaccacccggaccagctttttttcctcatcactgattaccaatatcgttcccaatcctttctcatcctcataagggcttccctatagaagtagtccccccacaggttgaattcatccacgcccgactgattgaccccgttctccttcgaccgtttcgcatacgttccgtgaagcagaattccggctcctggcgcgccatctctcaaaagacagcgatccgtcaatgccttcatcagcttagatgccatggaaatgagcaggcctgccttttcctgctccacatagcgggccatttccaggaggccgcaggcggcgatggccgcggcggaggaatctctcggttccggacttccgtcattaaaatcaaaatcccagtaagggatcagatcagacggcagattctccataaaacaggccgtcacgccgtcaaagaggcgcatatactccgggtcgtggaaatagccgtagctcagggcggatccatagattccccacgcctggcctctggcccagatggacccgttgcggttgccctgctgggtgattcccttcacgggagcgcccgtctccggatcaaagtaataggtgtgatacgtggagtagtcgtctctcaccacatgggccatggctgtcctgatatggcactccgccttctcccggtaaatgggattgccggttacttctgatgcccagaacagaaggggcatattgagcagacagtcgataatcaaccggtattcttttggatcgcctgccgtcccccacgcctggaagaaaccgcccttctcctgaaatcttcccatcaggttgtcggccgcggccagagccgtccgtttcgcctgctctatggcggcgtcattcatcacgctttcgtgctgctcctcttccatggctccttctctctttaggagacgccatgccgccacacacgacgggctgaacagaaaacccatatcatgatggtccaccaccacccgttccttcatacgccgttcaaagtctgccaccgaggccagggcttcccgcttaaaagcggagtcccccgtctcctcgtaagagagccacatctctccggtccagaatccgtcggtccagtcgtcattggccgtcttcggatagattccatccacactggctgccgccggaacggtgctgccaaaatatgccatgttcctttttacagtttccacacagacggcaaaggcttcatccgcctcccgggccgtcatctccggcgcttccgccagccggttcgtcctttcataccgcttattttccatattttttctccatatactccacttacgtcttctggctcagatttttgactcaggtttctggctcagatttttgactcaggtttctggctcaggtttcagactcaggtttcagactcagatttctggctctggcttcttgcttccggcttaagcttcaaaccacagaatatcgttagcctttaagctcatggcctcagcctctccctctccgttgtagatgaccgtctcctgcggctcatacgtattgtttaccacacagtatttgcccgtagccggataatagtttacttccacattgaagttgtcgctgtaccatctcttcatctcctgctccctgccggccgcccagaaaatggcgcggtacagcattctggaattctcgaaggaatacggaataccgcttatatatacgcttcttccctttccaaactcgtgaaccgccatctgaacatcatggccggtgctgcgtaagatcttcgtaccgggaagcgcgtaaatgttcttcataccctcaccgaaccggatctcctccgcgctgtcctcagtaatgaaatggctgtgtatctcccagttatatttgtcagaagaaaggctgaagcccacttccttatccacgcccaggacgcctgccagtgcaaagtatcgcccctcgtgctgacaggcagtcggctcgcctacaccgatgaggccgccgccttccgccacgaattccttcaccgcgcaggaaacagccgggttcagccagtaactgccgccgctcggggccgtgtatgcatcgcctgcattgatcaaaacgctgcatttctttaagacagacggattttcgatcacatcgtcaaagctgatgaaggcgacgtcaaagggcatgccgctcagtccttccagcacaccggcgtaggaatacgtctgcttgtaatcgatggcgtgagcaaccatatgggtgccccaggaccgaagctttccccagctgtttaacacgcccacggtgaaatgattgtaaggggcttgtcctcccacattctcatagagaaggcggaactcatcacagatttcctcgatatactggataaaatccgggaattgaagagccagctttaagtagccgccgtaaccgatccggtcgatcggcttgcgcaggatggcacgtctcgcagtcacccagttgaccttcgcctccctgatcggatcgcctccctcatggaacacatccgggaagaaatacggcaggaatctgccttccgtatacttcacccccggaatatcggagatgaggcgaagggtggttccattccctacggagcctaccaccgcgtctaatcccacttccttaaaatactcgccgaacggttcggtgccgatccagtgatcgcccaggaacatcatggcttccctgccattttcgtggcagatatccaccaggaccttcatcagcttcgcaacctcacgctgctggaatctttgaaaatccttgaattccttagtcggaacgcggttcgtgttgttgtgatagccctggtcgatgatatactccggacggaaccgatagcccgcttccctctcaaactgctccagaatataggggctcacactggcgctgtatccgaaccagtccacaaacttttcttttgcatattcattgaataccagggtaaactgatggaaaaaggtagtaaagcggaccacatccgtatccgggttttccaccatccattttttcagcttatcgatgacatgctgctgcgtcttcggctgcctcacgtcaaatgtgatctggtgctctacattttcccagctgttggtaataaaattatacatatgtaccgggtcccagataataaaggccaggaagctgaccgtataatcgtgataacgttccggctgtgccagaatgacctcccggctcccctcctcatagctccaccggtccggcgccacgacctctccggtcgtgcggtcaacaacctcccaccagcgtttgatatcatcgatggtgttgggcttcagctgctcatcgtataagtgcttcatcaccggaatacgcagttctccctcttccattgccgtgtaaaactccgtcatcagatacatttgctgtacttcatccggattagcctctgcccacgcattgtcttttctcgttgtgtagtaggtggagtagatttttaccggcatggactttaattcatccggcatactggtaccgtcgcagtcacggagagcgtcggctccccagcgcttaacgatttccttagtctcttcaatcatatccacatcggtgggtacggttacccgtccatatttatcactcattgctgcttctcctcagattagtcgttgtttattttgtatgtacgaagcaccggttcttttccgttcagttcatacgcattggaatcggcgcgcagtcctcttccgtcctggcaggtcacccggatatacgtctcgctgcccgccagcgcaaaggaggcttccgttacagtctcccccggttttgccaccttcttatagcagttgcggccttccatcagcacatagatcttttccaccggactggtcttcacatgcagaacgccgtcttccacatacagttcctttatctccggccccatggagctgtaaaaattgccctttaagagagcatccacaatgctgtcgtaagtcagtttttccgccttaatcatggtaaatccaccgaaggaatcacagaggggatctccgaacggaaagctgttgtgattatcatccgtggaaacacagaacagccggctgcccagacgcagcatctcgtcatagctttgcggattatagccgtacagtccgtcgtgctcacatccatagttatagatctccatgccccagaagccgcggagattcttgtaatcgtcgtagttctgcagagaccagtaagggtggttgtagcaggcgaagaagccgtattccttcatgtgatcaatatatccgttaatataatggtaatcgccgtaacggctttccggaagggggctctctttcttttcctcctgaaactcctccggcttcgaatcgtacaggttaatatggtacgtctttaccctggaaaaatccccaggaactttaaagtgctcgtttatgtccacctcgtaggcggccagcgccacaaaattatcatccatcagctctctgtgccactgatatctgcggtggtccgtgtaggctaccacggaatacccctcgtccatatacgcttttttaacctcctccggtgtcagccggccatcggaatggatggtgtgacagtgaaggtttgctttgtagaaggtacctgtttccgggattaaatttactttgtttgacattatcttactccttccaaatttaaagaacttccttccggtaagcaatccatttccggactgtcaggaaacagatcaccgccgaaaccgccgccatcagaaaccagattacgatggtagcgttccatcccagggctacagacagtgctccgattccgtaagtggagacggcgccgcctgcgtagaccgaggaatttaaaaggcctgatacggaagaggctcttccgatcacgccaaaatacgatgggagcaccgcgatcagcatggtgttgaccgccatcatcgccgtcgtcgccagcgccagcatcagaaatgacaccgccatgctccgccccgacgccagacgcagcaccagtatggccgccgcgctgaccacgaaaaatgctcccgctgtccgcacctcattccgaaaccagtgaagattggcaaaggaggccagatagacccccagcaggttaaagaccggaataaccatggtgcttgtgattgccagaatggcgcttagtccgtacgtctcgctgatataagtcggcacccaggtggtcacgccgtccttcagcgccccctggacaaaaagggccatcatcagaaacagaaatccagactggatcagaagactcttccagttcacggcagcttttgccgaactgccggtctcaccagagggtatttccgccattttcccggattctgccgcataccgctccacccgcttcatgcctgtaatccagaacagcgaggtaccgatcagcaccgcgcctgccagaacgaacatggtcctccagccggacagccatatcacaagcgccgtcaggccgtaggccgccattgttccgaggggaacggagctgtttaatgatacacacgccttcatccttgtttccgtcttataatactcatacatcagccggatcatgggcgaccagataaacgcctggaacaggccatttacacaccagaccgccgtcatcagaccggaacccttcgcccccgccatagccaggttgcagaggccggataccatcagccctgtgaagaccattttcttcggggccaggcggtcgcctaagaagccgctgacaaactgccccgctccataggcgaaaaagaacgccgttccgatcattccggcctgccctttggaaaacccttccgaaaggataatccccgtcaggctggccgaatagttcagcctgccgatatacgtggaaaagtatgcgatccaacacagccagaacagaagtttttccatcctcgctacccttttactgcagaggagttgacgccctccacgaagtatttctgtgagaataagaacagcaccagcacaggcatcaggaccagcgtcgcagcggacatctgaagcgcaggatccgtcaccgtgccttccgtaaacagcttaataccaacagacagcatctgcttctccaggctggagatgaagatgtaaggccccatatagtcgttccaggaccacacgaacgtaaacagaatcagcgtcacgatcgatggcttcgccagcggcagaatgatccttgaatagatctggaaatggctgcatccgtcgatgcgggccgcctcgctgatctcctccggaatgccgataaatgcctgacgcatcatgaatacaaagtagatatcgaaggtagccggcagcaccagagaccacatggtatccaggatgtgaatctgcttaaatataacatacctcggaatcagcataatgtcactaggaatcatcaaagaagtcagaagaaccagaaaaattccgtctcttcccttgaaattaatcttggaaaatgcgtaagccgtgatggaaaccacgaaaaccttgatgacaatggtggtaaccgtcatcacgatggtattgatataccactgtccaaaatcatagtatgggtcaccgaacaagtccgaatagttggagaaaatgatctgatcgggaatcagctgaagcggcttcgtgagcacatcacctgaaatcttaaaggatgatgacaccatgaataaaaacgggtagatgcagacaaggccaatggcaatcagaacaatcgtccagccccatgacatctttttatctttcttaagcatagctcttcctccttaatagttgacccatttttgctgtccgcgccactgaatcagagtgatgattaagacgatgataaacatcacgagagcctgtgcactggcatagcctgtctggtagttggtgaatgcggttctgataatgttgatggacataaccgtggttgcctgtcccggaccgcctccggtcaaagcctgaatggtggtaaagttctgcagggatgtgatcacagaactgatcattaagaaaaatgtggtcggagaaatcatggggatcacaatattcttaattctctgccatttgctggcgccgtcgatctgagcggcttccagaagatccgcggagacgttctgaagcgcagccagatacgtaatgaagttaaggccgatgcctttccacacagcgatacacactaccgtcggaagcgcggtatttaagccgtacagcagatacggcggattctcgcttccgagagccgaaagtatgtacactaccggaccgtcgggaccgagcagcagcttgaatacgacggctactgccaccatgttggatacgtaaggaagaaagaacatggaacggaccaggttcttacagtggattcccttgtttaccatatacgcgatgaaaaagccgcataccatgattaacggcacatacatcagggaataaaggccggtgcgtcctaaggccttcatggtatccacatccgtaaacatgcggataaagttgttgataccgacaaaggacgcatcctccagcttgctgatatagcggacattggtgaaaccaaggaccaccgcgatcaaaaacggcagcccctggaaaataacgtagccgatcagatacggagcgataaaaagagcccctgtaaaattctcctttttctgagcaatggaggttttcacttttacttttgcattaccattacttttcataaacacacctctttttccatcttttggcacaaaaagggcagcccctaaggtttcccgaatggactgcccgtcaggtcagactagattactgcttatcttcttcgattgctctgtttgccttatcctgaatcttggttactgcgtcatcgatgctttccgcaccctggccgtaaagctggccctcttcaatgattgcctgagaaatggctgcgtcgccgtcgccaatgattttttcagaaagtgccttgcggctgctgtcaaaccatgcggtcttgaagtcttccacagtgagaccgtcaaactcaaatggcttcgccagggagttctcaacgtactcattgatctcttcgtctgttaagtcgattcttgcaggtacacggcccatgcccagtgtgtactggttctccgccatgcaggctgccgctgcgaatgctgcgtccttgttcttgctggtagtcggcactgcgtagcatcccggtaccgtcagagtagacggatcggttccctccggataaggcatcggaagcagaccgactttccagtctctcgggtacttgtcaaactgatttaagatggaagttacccagccgccgcacatgaacataccgtacttgccggtggttgcaaatgcgttccacggtgtgttggaagccttgaattccaaaatagagggctgaatcttttctgtattgcctaagccgtaatagaactccaggctctctttgaataacggatcgtcgaagtttcccgtgccgtcggccttgtatggctcccagcccttctgtaatgcgtacatgtagttgtagcagtcatagtccagcattaaggatccgtatattcccttggagctgtctgtcagcttcttcgctgtctcgatgtatttttcccatgtccagccgtctgctgtcgggtagtcaacaccggcatcgtcgaagatctgcttattatataaggtgatccagatatcggagaatgccggaagaccgtatacgtctccgccaaattccggaacgtagtcgccaaaggttccggcgatatcgtagcctgccttctcagcaagcgcgttcatcggctctaagacgcccgcgttgtagaacgcctttaagcctggctttgtgttgtagatcaagtcgatctcatcaccagccatcaggctgaccagagtcttatccacttcaccggatttcgcactcggaatcacatagaactcaatgttaataccggttttttccttaaccagttcgattaacttctggttttcttctccggtactggctgtctgtgtggtcgcatactttaaggtcacgccgtcgaatggcttgtcggaagcagcctctgcgccctctgctgctgtctcaccctctgcttttgtggtcgtttctgcggctgccgctgttgtggctgcatccgccggttccgccttctttgaagagcagcctgccagtgatcccactgccattgctgcacagagggacagggaaacaacgcgttttatatttcttttcattgtggtaattcctcccaactaatttatttgatagcataattgtaacgtgtaatccggtcagaatccatagttggaattttacctttattggttattcttgtcctttaccgatattttcggaaccgtaatgattacgatcgttccggctccctgcttgctcaaaacccgcacgctattctggtatccggtatagatggcgattcgctccttcacgctgtaaaggccgattccggtcccttttcgccttcgtttccccggctctgtctcgcatctcaccgcccccgtttcaatctggcggcacacctcctttaactgacttctcgtcatgccgcagccgttatctgccacacggaaccggatcacctccgcctcctcccggatatcgagccggatcttcagcacccggtcaatcccttccatgccgtacataaaacagttttccaccaccggctgcagggtcagcttgatcatggcatagttatacagctgatcgtaatcgacggtgctgtcgaattcaatccgctccttataacggttcttctggatattcacataggccatgacgtgttccacctcctgccggatggggacgatcgtctccccgtttccgatggacagccggtacagccgccccagcgccgcggcaatccgcccgatgtcaggacgtcccacctcattggatttccagacgatattttccagtgtattataaaggaaatggggattgatctgccccatgagcacctccagctccagctcctttttcttcttctcgctctccacctgttcttttatatagtggttgatctgcaccagcatggcgttgtagtacatcatcatgctcttgatctccccctggtacgcctctggttccacgtaggcctccagattgccgtcgtatacctccttcatggaagcgtccagcacctccaccggctgaagaaatcgcctggagatccagttgatgatggcgatacatgcagtcacacagaccaccatggccgcaataatctccttgaacaggcggtcgatgggctcggtggccgcatttaagggaaccacggtaaatatctgccagtccgcgttatttaacggactcaaatccgtaatataaggctcatcgttatactgaatctgatggctgccctcctcagccgcttctgcaagttccatgatccgccccggcatccggcacgtctcgacggcattctgatccgacgaagagatcaggcggccgctgccatccacgatgtagacggttcccttcatttcctcggccgacgccttataaagctggtagacctgattctcctccagcacaaaaaactgggtatagagccacgttccggtaaatggatgaagaatccggcgcatacacgtgatcacctgatctgtcctcacatccccttttttcgtcctgctgaggaaattactccgcaggggctgccactgaaacatggacagcttcgtccggtccacggctcccatgtcaatcatgatccgtttgatatcctctccctgaaaatagggatccaggaaattatatacttccttgttatttccatagatggcgctgatccgctggctcttccccagcgggtccgtcttcagaaagtagttgttcagtccatagatatcccgctgcttttcgatggtcgccctgtcgtaatccctggccaggaaatcctcgatctccgcgtcgtaggcaaatttatcggacaccagctgcacattatagagcagctcgtctacctgtgcggcgatggcgtcggctctctggcggatatttccgattgcctgattcttcatttccatacgcgtcttcaaaaacagcacggacgcaaccaccgtaaagggcagaagcacgcctaccaccagatagaaaaacagctgctgtcttaagccgcggtccatataatgactgagccgtttccacaaatctctcatcctgtctgtccctttcgtttccatcagttgtggagtccccggtattcatttgggctcatgccgcagtgcttcttaaatactttaataaagttagaagcatcggcgtatccggtcatctctgcgatctcgtagatttttagtgacatgtcccgcagcagcagcttgctgtgagccatccgcttctgtgtaatataatcgctgaaattaaatccggtttcttttttaaataccttcgatatgtaggccggatttttccggaattgttccgccgtagcctccagtgagacgagattggagcagtactcccggtccagatactcccgaatggaggtcaccagcatcccggtcttcttctggcccgccgacagatccggcgccatggaagagacatgcttccccgtgttcccgtagatctcaggcagtttttcctcgctgctgcacaggccgctcaatccggccagaagggccaggccgtatatgtcgccgatctctccctgaatctctttgatgcagcggcctatggcttccagctccccgtcgctgccgtccttcagcgtgataatccctaccaccttccggtcccggtttaggaagaaatgtttctcccagaccatctcccggctgttgcagtaccggataatccgctgcttcagctggtagtgatcgtctctctccccatttcccacaggctgggcatccaaaaccgccatcatacagcagtcaaaattcatgccggcgtcttccatctcctccttccagccgtactcttcctctccgcccacatacccgtccaggagattactgagaactctggcgtaggacagttctttattctgcatggccgaaaccttcagcgactccagctcccgccgtctgatcccctcttcatccagcttctccttcagccggtgaaacagcgtctcaaactcatcgatatccgtgggctttaaaagatactccgttacctggttgcggatggccatgtttaaatactccacatcgttgtatccgctgagaatgatgatcttgatctccggattattttcgtggaggtactgcatcagctcgatcccatccatcttcggcattcgaatatcggacagcaccacatccgggtgcttttccccaataatgcgcacagcctcttccccgttctccgcctgccccgccacttcaaagccccattcattccacggaatcccccgggccatcccgcggcggatatcttcttcatcgtctacgatcagtaactggtacatggctgtttcctcctcgtcgtattttcatgctgcattttaccattttctggatacttctgtcatttattgtataacgtcttttgcttcctgacaataaaaaatgcagtaatcaaaaataagactgaaaccgtttgtataaaaacggtctcagtctcaagttctgcctgatcggttttgctgcctgcggtagcttatattatgaatccgctatggctgctgaagcagggattgaaatactatttattaccatactctgcatctgcctccgtgttcttaagatagttctgtgcctcttcctttgaaatagattttatgccagtaatctgtccggccgggtcccgcacaactgccagatcggccgttccggtctcatccacccaaaacgcagggtaccagccgtcagtctcatcaacgaacaatctcactttctgtccattatagtacacggcgttttcatccgcacgaaatgttattccgtaagcgccgtaatacatattatatttctttccgttttccagaggctccgtattggagtccctggtctcatctgcaaaaaatgtgtcgtagtattcctgtgcttccttctcggatattgcgctcacaccgcggatttctccggctgaactgcgtacagccgacagattcactgtgccgtttttatcataatagaacgtttcatcagaatacggatcattgaaaagccttattttctgtcccttgtagagaagtgatgtgccatcattggaaatcgtaacgccaaaggaggaatacttcgcataaacagatgggtcgggcacgaacctgactgcgatatcttctttaatataaacgaaatcatccggaattcctgctgcggcagcagaggtggcaaacgaacttcccacaacagctacaacagcgcaggcgatgatcatggaacaaaccgttgtcttttttatcttcataattgcttcgatcctttcttcaattgcatttttactgaaatggttgcataaaggggtaagtccactcttcttttcctccatgtcaatcagcgtaagcgcataggctgatttcatggtttctccgaacatccgcacaacccgttcatcgcaggacagttccagatcccgatttgctaaggtatacatgatccacaccaggggattaaaccagtgaatacacagtgcggcagtcagtaaaatcttcgtcgctccatcaaagcgccggatatgtacgaactcgtgtgcgaggacgtattgtaactttttcgaatctgtccagtccgtttctgccggcattaatatgacaggccggaagattccataggtaagcggagccgttataccgctggtctgacgaattgcaacggaacgtctgcacttatgctctgccagccatcggatcgtaaattcgttttccaccagctgggaagtcatgaactcgaagcggcatctgatataagctatggcaaaatacagcgtacaaaacaccaatccgatgccccagatccagcccgctggtgtcagccccacgaccgcggcagtgttttgtacagcagccggcgcggtggtgaccgggataacgggcagcacgtttgcgattggaacgccgccgatctgtcctgctcccgaatactttgccagagagtagacgctgaacggcgagggccaggtaaacggcaccagcagccgcaccaggacaagcccccataaggcaaggaacgtctttttaggcagacggttgatggaaatcgcccgaatggcggttataacaaagatcatcactgcagcagaaatactcatttgaatcaggctcatgctccatcctcccccagctcctcgaccatctctttcagcttctccacctgttccgcagtcagattccttctgcccagcagagatgcaaacagcttatccaccgagccgtcgaaaaccttatgcagcagttcgtctgtttcctgtgcctgcacctgttcctgtttaataagcgcatggcagacaaaattgggatcggtccgttccacggccccttttttgatgcaccgctttaacagcgtataggtggtattgacattccagccgtaccgctctttcatcacatcggcaacgtgctttgccatgctgtcgccctctttccagagaacgtccataacctttatttcactgtcaaccagtttcatatccatattgattcacctcttttccttttatttataagactgtagtagtatccatactcatatactactccagtcttacgagaatgtcaatactacaactgtcttatttttaaatttgtttcagaaagaggtattttcatacgctcttctgccatctatggttccaaaacgaccatctgtcgaaaatcggttgaaatcagcctcctttttccctatactgaaatcagaaggaggtggtgatgggatgcagatcgaaatcagaatggaggaatcctgccgggaacctaagattattatcgtaaccgataaaataacagatgagataaacgcccttctcaaaaagctttccagcgaaacggcgccggtgatcgccggttttcacgaaaatacggctgagatcctggaaccgtccgatatcatccgtatctatgcatcggcaggaaaggtatttgcggtgactgttcagggggaatacctcctgcatctccggctctatgaactggaagaacggcttgacagcaaatgctttgtccgcatttccaattcggaaatcgtcaatctaaagaaggtcaggggatttgacttaagccttgcaggcaccatctgcgtctccctgtcagacggttcggctacctacgtttcaagaagatacgttgcaaaaatcaaacaggtattaggaatatgaggtgatagagatgagaaataagctgttaaaacgatgtctgatcggcgccccccttggtctcgccatcagtaccatgattactatcgcgatttcactgatcatcggtgacggcagattttatgcggtggtaccggacttaattaccgactgcggaagtgaaatcaacgcggttcttctgcaggctgtgtgttcgctcctgtacggggcggcctgggccggcgcctcactgatctgggaacaggagcagtggagcctgctccggcaaagcgttacccatcttgtcatctgttcccttgccaccttccccatcgcctacctgatgcactggatcaaacacagtgttttcggaggcgtcctgtatttcggaatattctttgttatctaccttgtcatctggctgtcgcaatactggaccataaaaaagcgtgtgatgcagataaacgaaaaagtgcagagagaaggagcggaccgctgacagcagcggaccgctccttctctcctcatacagactcacgccgcagactccagatttatcccgtcttaaaacgtcaaatataacgtctgaccgtcttcatgtactgtcggtacgcatcaccgaacgtgtccatacaccaccgctcttccgagagaatgatccaatgagaggcgatctggaatacaacgacaatgccgcacagaattacagaccgggtcagtatcacacagccgataaaatacagaaaatacgacaggtacatcggattgcgtgaaaaacggtagagtccgttctgattgattccgccttcggatggggatgcaaaatctttgattgtggctgcgcacaatgccaatcccagcagataaaccgccgctcctgaaaagaactgccaggagacctccggtttcaccctgagaaaacataagtacacaaagatcgcggcattggatatctggtagacccagtatgcaaacacttcattccctgacaatggagcgaaatgggccgcgcgttttactgcctcgctgctgaatcgcgccaggaggccaaatcgtatcaggataaacgggattatcaggaaaaagccattcatttgcagtccgcctttctgcctcactcctgccctgtccggagcggttatggatcctcacatcggttttaattcttattgagccggtcctctccttctggtaaacggcttcttcctacttcttttcgatgatctcaagattcacgccatccggatcgtggatgaagaaaaaacgggtattggggttcggctggaatggtccgctgacgatctccacgccctgttctttcatgtgccccatcgcctggtccagatcttccacggaaagccccagtgacggacattctccatatacaacaggctctgcctccgtattgcagattaattcgatctccgccggaccatctgccataaatgcgatctccgtgtggaggccgccaggaaatctgcgtgccagcttcatccccactatgttttcataaaactgaatggactcttccaaattcttaacgtgcagcgttgcaaatatgaatttcatgattttttcctccaaagtatataatcagaacgttgatgtcgcttctgcctgttattatatcgtatccggccgcttctgtcactttcttttgaaaccgtcttcagccttttatcgctgcctttcggctgcttaagacccacaactgaaaaagcttttcaagtatccagccgcctcttctttatcatgaaagttccaggagcagccggtaatatactgtaccgcatccgtccattccttcagggcataatcccccgttttcgacagttcctctgccctcttcaccagatgtgcaacggatcgttccggacctcgcagatcggaaatacagtcacagtgcgcggctttacggagttcctccaataattcttttttctgatgatttcccatcttctccgcctccctgactctggcaagcggccgtatcgctccccacctgtcataaccggccgataatgcctgatatagtttaaattatcccacccggtccaccgcccgttcatgctacttcccatatggacagagtgtttaaattgagtatagcataaaacaaagtaacggacaatatgcaagaggccgtctttcctgcaaataagcagaaatgaaaagtaaaagaacgagcagggacgcataggttctattgccccatgcgcccctgctcctgataatccgccagaatcttttccgctcttttctgttcatattccatcagcgccttccagctgtccgcatacccctcccaatcgtcattctccaataattcgtctgatttcctgaccaactgtgtatattctttgtggagatgctgctttctgatccggtacaatgcaaacggatacccccagaccaggaattcggacagcctggtatagcactcccggaccgcggctgacgggcaccgttcgatgataaaatccagcgccagcttaaaacaccgctcgctctgattctcattcagcagctgtttaaatccatatctcagcttatcaagatcttccttctctacatgctccagagtatacagaaagaccggacgaaccgtcaatgccataaactgaaggctttccctgtaaagccggaatccttccttcacttccagacgctgaaaatcgatctgttcaatatcttcgcagacttccgatacttttccctggtgtaaacggataatactcaggctgtccagaatgctgagcgtccggcgaagagtacggtacgatacattcagctgctttgacataaccggcatggacggaaggttccctcccaccggatacgttcccgttataatttcagttatgattcgtgaaaccatagtgtagcacagctgcggccgctgccagtatatgttccagtaaaaaggaaccttttccttccggccgtactccccatccatctctgcgcagaaggccagaagctggctgatgcaggcagcaaagtcaccttcaaatgccgcattcataaactccagctcctgctccctcccgtcagccaggagttccctgtctctttcctcgtgcatcccgtgattggccagatacggaaatcgaatgtagcgcagcagctcccagtaaaaattcaaaatcagtttatttcccaggtctgaaaaaacctgaatatgcatcctggtggatatggacaaatccacgttcttcagctttgccatgttttcctttaaccggtcccaggattccctgtcatagcttttctgtgcatactcccagaccggctcaatcagaagcttaccggcctgacaaaagtctatgatcccgctgcatcttggcacaaaatacagcgcggcgttctcttttatctggtctgcactggcctgatagatcacctttgccgtttttctggggctgacctcgatatatccgtttttttccagccgggaaagcgcagcgcgcacggtccggggagccatctgaaaactcccgcctatcctgggaatcgccggtaagttctccccatatcggcaagcccccaaaaggattcttgtctcatagtaatcgtaaaccagattgcaaatcaaatctgcattttcaaccaaaattcttctcctttttcccctgtcaagttcacttcaaccataaaatacccggacaattataccacacgaacgggaaacacacaagaaaagggagttttaacggcatatacatttctgaagcgctgccagcagacggtcaaaatcaatcggttttgtgacgtgatcgttcattcccgcggccatcaccttcgagatatcctctgcaaatgcattggcagtcaatgcgatgatcggaacagtctccgcttccggatggccgctgccgcggatctcacaagccgccgtatatccgtccatcaccggcatctgcagatccatgagaatcgcgtcgtatgtccccggttctgagtcgttaaagagctttagcgcctcatacccgttctccgccctgtccacgataaagcccgcgtcccgaagcagcgtctccgcgatttccatattcagttcattatcttccaccagcagaagccgcagtccatggagacacgtctccagctttctcccggtattgcctgacagtgcccgcaggactgccgcctcgtcgtcttcctcttccaaggtcctgatggtaagtgtgacaataaagcggctgcccgcgccctgtttgctttccacccggatacttccctgcatggccgtcacgatgccgtgagagatggacataccaagaccagtgccctgaacctttctcacatggcagttctcctcccgggcaaacggaacaaatatatgatccaggaactcctcgctgatgccgatcccattgtcctcaaccgtaaatacaaagcctcccacccccggaattcccgacatcatctccttggaagtgacagtgattgtgcctccgtggggggtatatttaatggcattgttgatgagattgatcaggacctggcggatcttgccggcatctcccaggagattgtcatggatgatatcatctgtcaggaaatgcagggtctgtcccttttccatcgattcattatagacgatgctgccgatctcgtggaacaggccttttaaagaaaacggcgcttcggtcagcgtgatctgccctctctcgatcttggacatatccaggacctcgttaatcagatgcagcagatggctgctggaaagactgattttctgaagacagtccttcacacgttctttatgatctgcctgtcccatggcgatcgccgtcatgccgattatggcgttcatcggtgtccggatatcatgagacatctgcgccatgaaattactcttggcctcgttggcattcctggctgcctcatacgctgcaaacagcgcctgctggctctgcgcctcctgctccttttccttctcaacattgtgagaggctaaaataatcttaatcggagccccgttcctgctctctgccaggatgacgtgaatccgcatccagccatagtaaccgctgtaatccctgcgatactccaaattatagattgtctcgccttcctgcacccgtttcttaatcgccgtcagacacatttcctgcttaaaacgttccttgtcctcctcatgaatcagatgttcatggtagatttcaaacagcgccccatactcatctgaatggttcagccgctctgcaacatcctcccggatgacgaaggtctggaaggtctcttccaccaggtccacgtagaaaacagagtggtagaaagcggaaagtcccttaatgatattctgagattcgaaatacagtttcttttgctgctcttcctttaactccgtcagcttctgctcgttgatgtccatgttggcaaaaataaccctggtgataacaccatcctgaatttccgcaatgctgaaccgggcgcggacccatcggatacaatccggatagagtcttcggaaatcgacttcgtagactggctgctccgcggacagggtctgacgcaggaaatcaatactctcggctctgcgcattttctcctgatcttccgggtagacgtagtatttcacaaacttctcataatagacatcgagcgcccctttggggaactctctgtttttttgaatgaagtcctcctgccagatcgcctcctccgtgttgttcacatagtcgaacaggtagatggaatagtagcactcgcagagattggccaggatggcttcccgtctctgaatctcatacttatcatccacatttctcacggtcagaagaatcctgtcttcataattctgactgatgagggcggaataatagctgtaagcatgcagtctgccctcctgatcgtacatgtgcagcataccttccctgtattcaccggcgccataattttccgcatcaaaaatgcgttcaaactccctccggtcttcctctggcatatttttcacagcctgctcccggaaatccggataccgtcctcgtctggtaagctttaacagttctcccgaatagtaaatgcagttataccctgccttttcgcagtccacactgatgagcagcgtataaatctgagacaccgcaacctgtgcgctggcctgatcgatccgtttttccatctcgccatcctgctcttccatggctgcgataacccagggatattcctcggagtactgctttaggggaaccaccttgattctccgccaccgtttttccttcgtcctgtaaatcgcttccacgccggaactgtccgcataaaatctttttcggatatactcgggattgacggcgttcagaaacagttcacggttttgccgtacgatctcacgttccgcatagttacggaaaaatgtctcaaaatccgccgccccttcgccaaacgcttccagctgctcagtggcttttatgattctgtattcaccggtatggaggttacagaggatgatccccttaaaattctcattcagtttctccaatatggtatcatactcctgcttcagcataaccgtgttggtgatattctggtggtatcccagcagacaggtgccctctttatagttcttatctctgatcccgccgcagcgcacataaatctgcccccataacgggtggtgccacggatactccacctcggccctctcatcggcacacatccgacggaccacgtcctggaccatgggatagtaatctacatcgatccggtcataccatccccggtaacactcctccggagacggctcgccggtaaagccaagaagctccagcatggccttatccgcgtacattctcggttcccgtccctcttccaactctatcgcccacagaccggtctgggcctcatgcagtatatcctgaatcttctctatatccctaaagtgttccgccattcgccttaacccccagcttcaaatagtaacccggcggttttctcaccaactccggtcccctggtcttccctcatactgtacttcattttatcagattcggcctcgtattacaacttatttacacttgctggttgtatgaaaaaggagttacaaaaaacagcccggcttatcaccaggctgcttgtttgtaatctctatacctctgctgttttctgaaacgctttcccattaccgactctgtcgtctttcgttacctggagagcccggactgcatttaagatggcaatgacggagacacccacatccgcaaataccgccgcccacatgctggcaaatccgatggctcccaggatcagcacgatcgccttgactcccagcgcaaagactatattctggtgaacgatgcgcagagtctttctggatattctcatggccgccgcgatcttggacggctcatccgtcataatgaccacatcagccgcttcaatggccgcatcggagccgagtccgcccatggcaatgccgatatcggcacgggccagaacgggagcatcgttgatgccgtcgcccacaaatgccagctttcctttttcactggtctgagacagcagctgctccatatggcttaccttatccgcgggaagcagctctgtatacacttcatccaggcccagccgctgcgctacattctcgcccacggcctttgcgtcgcccgtcagcatgacagtcttccggattcccgactgtttcagttcccggatcgctaaggccgcatcctccttcacttcatcctcgatcaggatggctcccctgctgattccgtcctcagccacgtagacaacagttcccgtctctctcaccggtttgaatttgatgtgatttagattcatcagcttgctgttgccagccagtacggtctttccgtctaaggatatggagattccatggccggcaatctcctgaacgtcagccactctggaggcattcagttcttttccatacgcatttacaatggatttcgagatcggatggttggaatccttttccgcgtaagcggccagctccagaagcttctccttcgtaatcttttccgggaagcacccgctgactgcaaacgagccttttgtcagcgtacccgtcttatcaaagacaaccgtctctgttctagcaagcgcttccagatagttgctgcctttgatcagtacgccgcatttggaagcgccgccgattccgccgaagaaactgagcggtacagagataaccagtgcacagggacatgaaataaccaggaaggtcagcgcccgctcaatccagaccgcgaacggctgtcctgtcaggagcggaggaaggactgcaagaagcactgccgcagctacaacggccggcgtatagtatcttgcaaatctggtgataaatgcctcggatttcgacttcttgctgctggcattttccaccagatcgagaattttggccacggtggactcgccgtacggtttcgataccaggatttttaaggtaccgctctgattgatgcagccgcttatcacatcggctcccggttctacctcccttggcagggattccccggtcagggccgaggtgttcagggctgaacgtccttccagaatggttccgtcgagcggtacccgctctcccggctttaccacgatcacttcgccgacagccacctcatcgggatcgacggacacgatcccatcttctctcaccacatttgcgtaatccggccggatatccatcagcccggatatggaccggcgcgacttgctgaccgcgtaggactggaacagttcacccacctggtagaacagcatgaccgcgacgccctccgcgtactcgcctaagaacatggcacccacggtcgccaccgtcatcagaaagttctcatcgaatacctggccgtgtaaaatattcgtaaccgccttccagatgatatcccatccaatcaccccataacacagcaggaatccggccagtttccccgttgggcttaacggaagggccatggtaatcagatagatcgctgctgccgctaaaatccggtataactgttttttctgtttttttgtcatatcatttccctcttcgtctgcggcggcgggaatatgctgtgccgccgcgcttttatagatgcaattgtctctcgcttacacgtgattctcaattaaatcttcttaacggttacatccggttctattttctttatcagctttacggcttcttccgcaatctcctggaaccggtcatcggctgcctccagaaccatcttctggctcaggaagttgacctccacatttgtaactccgcttatcttcttaacagcgccctcaatcttcgcagcacagtgtgcacagtctaaatctaacagcttaaatgttttcttcataaggaatatcccctttcaatttttgtttcatatgaatacttgttcatatgttcatttgtattctataatagatcaaacgattcgtcaatggatagagccattttctgtccgtttggatcaaaatgctgtctttttggagccatttgatttttttttgctgaatcttgatttgtgtgactctccaatttgtccattcgggctctattcaggtcttttgggagcgtacagaagaaatatctctgtgatataatccggttggttagaaggagctaaccgaaaaagaggcttacgcaaatccagaataaaaataagcttacataattccacaccaaacagaaaagagggatacatatgacattggaaaacggaaatcctggacagacctaccaggtgatgcggtctgatcttccgctgaagctggaaaaacgtatggaagcgctcggcatgactgccggggcaaagctgtcattgattcataagaaaagaagcggaaccgctgtcattctgctgcggggcacccgctttgcagtgggacgcaggatcacttcgctgattcaggtcagggaggtgtcttaaatatggaaaaagaaatgactgttggttttatcggcaaccccaactgcggaaagacaacgctgttcaacgcatttaccggggcaaatctgaaagtcgccaactggcccggcgtcaccgtggaaaaggtagagggcgccatgcagtatcacaaccatacctatcgtctggtggatctgccgggtacctacagcctgacctcctacaccatggaggaacaggtgtcgcgccagtatatcttaagtgatgacgtggacgtggtggttgatgtggcggatgcgtcctcgctggaacggaacctttatttaacgcttcagcttctggagctgggaaagccggtgatcctggcgctgaacatgatggatgtggtggaaaaacgaggcatggagatcgatctgcaccgtctcccggagatgctgggcattccggtgatcccggtctccgcccaaaagcgcacggggctcgacatccttcttcatgccatcgcccatcatagagaccagaggagtaccgatccgctgatccaccaccatacctccctgtcccggagcgaaaagcacgcacagtatgccgtcgtctacagtgatgacatggaaaacaggatcgaccggattaccctggcgttaaaacggcggtacccgcagatggaaaactatcgctggcacgccctgaagcttctggaacaggaccaggaaatcacagaaaaatatccggtgaatcttcctgatatcctggaccgtagctatgagagcgacatcatcaaccagaaatatgactttatcgaggaaatcatacaggaggttctggtaaacagagagaagcagtccgctctcaccgcgcgtgtggacggaattctcctgcataaccttctggcgattccggccttcctgtgtattatggcgctggtattttttttgacgtttaccattggagactggctgaaaggctatctggaagcatttgtcggatggagctctgatgccgcggcgtcggcactggcctctcttcacacaaatcccatgatgatttccctcgttgttgacggaatcatggccggagtgggcggtatcctctcttttctgcccaatatcttcattctgtttctggcgctggcatttctggaggacagcggctatatgtcccgagtcgcttacgtcatgaacggaatcatgggacggctgggtctgtccggacgcgcatttattcccatggtgctcggcttcgggtgtaccgttcccgccctcatggcgtccagagtgttagaggatccgaaagaccggtaccgcatcatgctgatcaccccgtttatgtcctgcagtgcgagacttcccatttacctcctgttctctgaactgttcttcccggaccacgccatgctggtatcttactgcatgtatctgatcggaatcgccgttgcgattgcgtcggcatttctcctgcataaaatggaccggaaaaagaatgaagatcttctgctgatcgaactgccggaatacaagctgcccagcgccaggaccgtgtgcatctacgtctgggaaaaggtaaaggactacctgacaaaagccggtaccaccatatttgtagcttctattattatctggtttattttaaactttggtccacaggggtatacttcggatatggcggccagcttcggggcgaagctcggttctctgctggttccgctgctggctccggtcggccttggcttctggcagattgtcgtggcgctgatcgcgggtatttccgcaaaagaggtggtggtttccagctttattgtcctcttcggaatccaggggacgaagaccgccggagaaatggctgcactgaacggccagctgtctttcataggcttcggaccgctgaacgcgttctgcatgatgctcttctgcctgttgtatatcccgtgcgccgccaccttagcgacggtgaaaaaggaaaccggaagcgcccggagcatggggaagaccgccgcatttcagctgcttgtggcatggggactcacgttccttgtctatcagaccgtcactctgttcaccggaatctgacgtttttcatttcgaagcagaatatttcttccaactgtgttacaatagcggtaaacagacgaggaggctttccgatggatgaactaacaaaaccgcgctatcagatctattataatcaaaagccgctgtccccgcaggttttctccgatctgcatgtccagtaccagtatgggaaccgcgaaaatcccggaagtatggatgtatttaccatatttccgggaatcgaactgatctataatgacttttccatggtttactgtgacagcagcctgaagacagagagcgaactgcttgaaataaattactgctaccagggccgcgaagaatgccagtggctctgcggcgattacctttacctgggcgagggcgatttatgtattacccgcatggaggatggcactcccggcctctactttcccacgggccgttacttagggatcacgattgtgctggatctggggattctaaaagaccatatgcccccgcttctgaacaatgaaaaactgcggctgcaggaattcggcgacagattctgccccggcagtcacttccttgcaatccgtgccaaccggcagatcgatcatatatttggcgaactgtatcagattcctcaggagttccgccatgattattataagatcaaggttctggaactcctcctgttcctgagcatgatcgatccggaacaggaacgcgccctggaccgtgtcaccaagaatcagatcgacattatccggcaggtacagcgccggatcacgcagaacctccaggaaaatataacgatcgatcagctggcaaaggaattctgcatcagcccaacctccttgaaaagcaacttcaagcaggtctacagcacgactatcaaggactacttaagaagggagcgcatggagcgggcttctgccctgcttctgaccaccggcagcaccgtggccgatatcgcggcttccctgggctatacgaatcagagtaagttttccgccgcgttcaaggcagtccatgggctgaccccggtggagtatcgcaggaagtgccggcatgagcggaaggattgattttcattgcagctgtttttcactcttttttcactgcaatccagacctcctgccgcccttcctgcatataacactccataatcggcagatcctccagctgataccctgaatttggcagccactcggtataaaactgccgatatatgttctgcaccgcatccggaagccgcccattggcctcaagtactgcccatgtcgcggatttcacctgaatttcatccatgccatctggcgcaggaacatgtatgcagccttcagcctccacatggtttgtcacacctatgatataatccatctcttcggaattctcctgcttcccgccaattgacattccgataaagccggcgggtctgtaatccgtcttccggaaaagatccgtcagcaggttcatcgttccatctttccaggcagtatcccacatttgcgggatttgcccgaaagcctgatccgtttttatccgcctcctgattcccgcgactttaaaggccggccactgttctatctgatagctcatatgatgttctcctctcattgttatttgaacggagagttttggacaggacttcagcctgacgggctcatgtctgacttttgacggcaaaattccgtgaaagctcttaaacgcgcgggtaaaggaatcctgagattcatatccatatttcaccgcaatatcaattattctatcgctgctatttaaaatatcaaatgcagccagagtaagcctcctgcttcggatatattctgacagcgatttatccgttatataggaaaatacccgttgaaagttgtacactgaacagcccgcaattttagctattttctgataggaaatagttccgtccaggttttcttcgatatagtctatcgctttatttaaatgttgtatccagtccatcttctcacctccatcacatcattataaaggttctgccagacagtcttccgacagtttctgccgtataaaggcggaatcccggagaatttatccttcctgttattataccatcattccgccgtccggtatatatacctcctctcatactcctcctgcggcatgggcttcgcataatagtagccctggacgtaatcgcatccgacggtactgaggaaatctctctgttcctgcgtttctacgccttccacaatcaccgggattccaaggcggccggccatctggatcaccgatgagagtatgatcttccccttctctgcctccatgcctccggaaaggaaattcatatccaccttgaggacatccacatcgatgtccttcagcatgtttaatgaggagtagccgctgccgaaatcatccatcatagtcacaaaaccggcgcgccgcagcgcatggatggctgccatgatctgctccggatcggaggcataggcgctttcggtgatttccagattcagcagggatacgggaacgtgatatttctctgtcagcttccgcagcacctcgaccagatccggatcaaggagagtgaccctggaaaggttgatggtgacgggatttatgttttttccatcacggcgccatttcccgatgatccggcatacatgctccgccacatagtaatccagctggacgatgaagccgattttctcgaataccgggataaatttccctggcggaatcagaccggctttcggatggttccagcgcaccagcgcctcggcgccaaagtccgtatctgtggaaagggcgaattttggctgaaaaaacatgataaactgctcctgttccatcgcccgacgcatgtcattcatgatcgccgtctcttccgcttccctctctttctccccttcatcataaaatccaagacaggaggcatacagatgcttgcactttttacttccgatgaaggctctgacgtacatttcctcaacggacaagtccggctccgccacgacgtaggcgccgaccgtaggttccagcaggtaatctttctgatattcgtttaagtattctctcaggtccttaatctgctcatccaatatatccggatcaaagggctggcagatgcagaatgtatccgctatgattctgccgtatgtacacatttcaaaacgttctgcatgcttccttatgacctcagccaggaaaataagcagtttatcgccttcctcctcgccatatacagaattgtacagccggaaccggtcgatatcaaaccgcagcagtacgaaccgtgtatcccggtgcgcgtcaatcatgcgccgcgtctctgcaaacatcttgccccggttgtataagccggtcagcgtatcgtgctgcatcagaaattccatacggccgggcagcacccgtctcctctgcatccatcgttctcttctgccggcggctccccccggcatagttctctttctttttctcttcatcacagtcacctctgttccgggaaattatgcaggcaggcattcacagatcatgcggagcacctccatcccgcttctgaagcaggcactccccctgctgtttctgataatgccctgtatgctggcgttctgtctggaatatatcgtgacagcaaatacattttccctggtattcaggcggtttcgaattgggcaaaacttcactttacgcggaaccgtttcggcgtccgaaatgattttcgttctcttttttaccggatccatctttgccaggtgacggaattctccgctatccgccggcattccttctctgtccagaatgtattccatcagaagcagcatgtgatcaagcccgtgaaagcagaacgatttttcctggtataaagactgcaaatatccgtttatcgtctgatttctgcagttttcaatgacaattatcaataccgctctcatatgatttccttctctcattcgtatgggccgcctgataccacagaataactattctgtggtatcggcagtccaaaaatcacagagcgcgctctccatatctgctatttttcttccattcaggataaaaatgggttctatactgctacgcgaccagaccggcaagaatcagcgttctctccggcctgtttattgtgggtaaaaccatagatatgtacattgactccccttattttttgttgtaaaataattagagtttcattttttaactttaatagggctttttgataccacagaatagttattctgtggttattttgtctaatccgattctcatccggttcatgaccttttcatactgtctcgtacttgtcgccacatagatgcgcgtagtctcgatcgatgaatggccaagaatatctgccagatgggccagattcttttcgatagagtaaaaagtcttcgcaaacaggtgcctgaaattatggggaaacacctttgacggatccacttttgcccccttacacagcttcttcagagaatggcagatattgctccggtccaggtttctgccgcttttcgtacgaaagatacagccgctctttattttttcgcttcggataaattccttcagcttcttgatcagatttctcggaaagataatcaggcggcattttcccttcatatagatctctgttttcccccggcagaccgcttccacggtgacgtagggcagctcgctgattctgatgcccgtgctgtagagtaccatcatcaggtaatagagctgagagtttcccattctccccgcactgtccaaaagccttcggtagtcgttctctgtcagttcccgatcctcatcgatataagcctttttctgaaccttcaggaattttaccttgcacatatccagattcataaattccagatatgaatggatggccgagagcttaccgttgacggttcctgccttgtactggctgctgagataccgccggtactgcaggatcgcctctttgctgatctcggctttatccatataggcaaacagctgttccacctcgtgcaaatacttgcttatggtggaatcggctttttcctcatttttcagatagtcctcatatcgtttgatattcattgcaatttccataacaggcctccatttttctagtcagatatttttaagtggttgtatggcaaaggcacagtacaccgaaacggtgatctgtgtctcaagcagccttttttagtttccttataatcgggcagaactatacatcggttttgggacttatgatgaatgatatgaaatagaaacaattcacgaaacttgcctttgcgttacatcagaagaacgcacaggcagtactagaaaagccggcattgaagcgatgcgttcaataccggctttatatccactgatacgtcatatttatgaccctgattctgaccctgatcaaaatcatggccgatctgtttccattttctgcagcacaacatacacatcatcgtaaatctggccgtttgcaggccagcatttaggggcttcccctgcactaattggtttatatttccaattattataatggatacagtaacaaatctcaacttacctcgttcgacttaaccatggactgctgcgcagacagcgaacattttacagtcaatagtttctgtatatcgtcaaaattttccttacatgcaactcgataatgaatccagccgccgtcaccgcagggatactttgtgtcgatgtactccctggtatatggatgcagctggccgtagacggaatcatactgcttgtcagacaatcggaccatgacagtaaacccattgttttcggcaaaaatattacataccagtttttgcttcagccggtgagcgatcccccagccgtactgattgccatagggaaagacgaccttctgccctgtcgcaaatgtctgggacagccattcgttcaacgaggtaaagaatccgccgttttcaccgcaatacgcggtcatctcggcaatagttggttcttctgttttattcagcattctttcgtacatagcggcctccatcaattctaattgtacgttcgattgtaccacaaacgctgcgcacgaacaactgattttccggggcagaccgggaagcagagaccgacagggctgtgaactgcaactatttttctgccaggaccataaaaagcggagaagtgttcatccacagcttttcttttaaggagccttccgcccttttccgttcttcgtccgatataattttccggttaatattcgtatcgacggttatggatttcattccaaggctgatcagtatatctacatcccactgcggacggatcaggctgctgattcccagctgactggctatatcgttccgctcccgcaacatttccaggctctgggccgggtgctcgtatctgccggataacgccgcatgaacgctctcttccagctctcccgcctctcccgtccggtcggcctccaggaaggcggctccgtaattcgcatcgcaattcatcagacgaccgccgggagccagaacccgtatcatctccagatacgccttctcaggatcgggaagtgtccatgtcacattgcgggtaaatataaaatcaaatgattcgtcgggaaattccagagactgcgcgtccatgcgcaaaaaccagatatcattgcagttcagcttttccgaattcataatcgcatggttgatcatctcctgcgaatagtcaattcccaccacttcacaattcagatcgtgaaggataattgagaaaaatcccgctccggttcccagatcaagcgcccgaatcctctttttatcgggcagcgctctctttatctgctctgtccagttcatacgcttatactcctttaattcggccagctaggcatcactgaattcgtccgccctcatcgaccagtatcgattaattctttcctgaatgtccacggttatttcacctctgatataaatgagaaacaaataaaaaaagccacgaaagtaagcgctgaaatggatgcgcatttcccttcatggtattacaattcatcttcgtgatgatgttagagtcattatagcataattcagactgttcggccagttttttacgcaaatattaactattatttactcaaacgtttgcttgcttttccagatcttttgccgttccctgctgccggatcacaccttctctgttgctgaaattatccgcgatcagctctccgtccacgaaagtttccagggacatcggacaaaaaatgccagagaaagacaggtatttttcccggatagatgatacagtttacttataaagattggagggaacactatgaagaaacggccagtcacaacactatttatgctcagttctgtagatgggaaaatcagtacgggtaattctgatctgctggatgtggacagcgattatcctgcgatggacggtgtaaaggaagggcttcatcaatactatgagattgaacagacaacggatctgtggtcgctgaattcagggctcgtacaggccaagctcggcgtaaaccaaaaagagtatccggacaaaacaccggtttctttcgttgtcatagataataagaatttaaccgatcacggcgtaagctatttctgcagacgggcgaagacttttgtgcttgtcaccacgaatacgcagcatccggcgttttctgtacaggaagataatctgcatatcatctgtcaaaaaaaattagatttaagagcagtgctggaagaattgtatgcggcataccattgtgaaagaattaccatacagacaggcggaatgctgaacggattgtttctccaggagaagttgtttgactgcatcgatatcgttgtcgctccggttctgattggcggaaaagataccgctacgctgatcgacggagcatcgattacgaaaagggaggaattggggctgttgggagttctgaagcttgtggggtgtgaggtgctggaggattcttatttgcgtttgaggtatgaagttgctggaaaaatcttctgaagcagacctgccagtgagccgcaggtctgcttcaaaaggatctgtactgcacgaattttcaatttttttaaaaatctgctattcttcttttcccatgccctttacgcatatgaaaattacgattgcagtggcaatgaggaattctgcaaaaattacagatggattccagattgcgaaataaaagtgtccaacgaaatatgcagctgtaaacaggagatacactccaatggaatatgcgatacagcgaattatgtgactgcgcttccgttcccggactaacatctgttgctgctgtttctctaacagctctgtctttacagacaattccgtcatttccgaaggtttcaaaagagagtctgtcgtcacaccgaatatgacgcttaatgccactattttatccaactccggtaccgactgcccggattcccactttgaaacagattgccttgaaacatttaatttttctgccagctgctcctgtgttaagtccaggctttttcgcagcgtcaaaagtctttctgaaaaatccatatacccgcctcctcgattttgatatcctaacaataccaaaaatcccggttgctttctatacagcaggctgtatttttacgcaactgccggttgagctctcggatgagcaggctttacatattttcaacacagcttctgcagcctacacgctctcccgctttatctcccacatcaccggcagcccggccgtaagcccgccgccgcagtgggaagaacagcccgaacagctgtggccgcagcttccaacccggcggagatatccggcgtgctccagatattccatgcgccgccggacatcctccacgtttgtcctaagtgacagagccagctcctccaccgatctggctctgccgtcttttaacaaatccagtaattctgtcataatggtctccgcctccatgatctcagttcgcactctctccaaaccgatcctaaaaaatcaccagccccacatggtacaccacaaaggacataatcaatgccatgacaacatagtacagtgcaatccgcccggtccatttggcggaatgtgtctcctggtaggtcgatgcaaccgccacaatgcagggaatattaaaggttactgcaaagatgaaggccagcgcctccgccggggcgatgttggcaattaagatttctcccagattggccgcctgccccgcggttcccacagtagaagcaaatacggtgccggttccggcgtacagggagctgagcacgcccagcgcggcctccttgctgacggccgaggatacgaaagcaagaaaggtctgccagcttaagccaaacacgcgtgtcaatggctcaatgaacgtaccgatgcggtaaatcacactgtgttccacgtttccatccgcagtataggacaacagccagaatatcagagaaatcagcaaaattaccttcagggcgcggatcagcacgtctttcgtccgcccgaatacatatcgcagcaggcttccccacttcggcctgtgatagggaggcagctccataatcagcccggtccgctcttccgccttcaccagatgacggccgaagattttagaggtgatccacatatgcagaagtgccaccgcaaatatcgccacaatcaccagaggcgcccaaacgccgaagaacacgctggatatcatcggtacaatagcccatgtggccgcgcatggaatcgcccacgccagcgcaatcgtcagaatcctctgcccccagttatcgatgactctcgttcccgccgcaccgccgatcgtacagccaaagctgaccagaaacggcatgatcgcctttccctgaagccccagctttgccatcgtattatcaaacacgtaagagatcctggccatatatccgatctcctcaataaatccgaataccagtgtaatcccgaacacaaagccaatcatggaaatggcaaaatacagggcattgatccccacatcgcagatcaggccaatcagaaactggggcgcgtgaaccgcggtcagcccttccgtcagcattggcgtcagcagggaaggcagaagacttccgcccaccataaacggcatggcagggataaaggaggccaccagccccagcagaatgatcgccaccgccagcggttttccatagcgtctgctggtcgcaatgcggtcaaatttccccagtgatgcagtgcgcttttctccctggaccgccccctttaaaaggcggtcaatccatgcgaatttgcattctcccgtcaacagcgctccgtttttgatctgggaaagctgctgctccagcgcccggcgatcttccggtttcaggaggtccttcaccctcgccgttacagggatatccccctccatcagcttggccgccagccagaagtccgaatactgccccatgcctgtctgcggcatcagctccttaatcccggtaaatccctccttcttctgatactcctgctccaggtcccaggtatccagcagcggccggtcccgcagaacccggtcgagcgccctgtaaaatccatcgtaatgtctgacatcggtagccgaaaatgccaccacgggaattcccagctttttttccaaccgctggggatcgatcgttttgccctgatccttcgccacatccatcatattgagcagaaggaaggccggcgtccggattccagcaaaatctgccagcataaacaggcttctctcaagctgagaggcatcggccaggatgcagaccgcatccgcatttccctccgctatgtaatccctggtgataatctcctcttccgagttggcggacaaactgtaggttccaggcagatcgactacggtatagcgctgattactgcggacgaaatatccctccttctgttccaccgtttttccaggccagtttcccacatgctgctttagccccgtcagcccgttgaacaaggtggattttcctgaattcggctgccccagaagggcaatgaccggttcttttctttgtgtttccgtcatttccccgtacctcctatcatgattttcccgcactcttcccggtttaatgcaatcatgctgtcccggctgaataataaaagcggcctctttctttcattttggaggacggttaccgggcaccccggagtcagcccaatggacgtaatacggcttagaaaacgggtatccccttcaatatcacagatgatgccgcgttctccgcttgatgtttcagacagctttttcatactcactcatcctttcttctcttgatttcgcatattagttgtaactaactcataatcaaaacctaaggggtgccgtagtcacgacatccccagaagtttaaaccatcccgccgaataaaattccttcagatcgtttaaatatacaaacgccttatctcttggcatatcatgccgtaccgtctcgaatatcccgttaaacagggcgctggatacgatgtgaatcaacgcgtcgtcaatctggtgaatctgctgccctgcctcctccatgcgttccagaagtgcacggccggaattggcttctatctccaccagtgtgtccaggtagtgctcgtagccggttcccgccgagcagcagacgatcagcttaaaggcgtcaaagttgtcgtagataaactccatgatccagctgttttcatccgaaacctccggtaattccgtcagttgatcctgcagcggctgatccgcaaattctttctgtgcagcccggtagcgttcctccagctctctcgccggcttctccaccagtgcggaaaacagctccgccttgtcggtgtagtaccggtagatcgctcccgtagtcacgcccagtgatgcggcgatatcccttaaactcgccccctgaaagccgtgagccagaaattcttttttcccggcttccagaaggtccgccgccagtttttcattaataagtcgcatgatcaattctccaatccaagtgatccctgattcaaatggtttccgattctgttattttgcaattaaataactatgttatcttatgacttttgtatcatagcgcttacccgtggtattgtcaatacaactttcatctgaaaggtcctaagtgagaaactttctctttccggccggagaagaaagcttaagcaggctgctcagggcgaaaaaacgcctcctttccctccgaatagattcctggccggcgcagctgcccatggcctgtcaccccttctctggccccatccatggccggatccgcataacggtaaaaccagtgattcaggctgtcgttcatctcttcccggaccagacggtatgcctcatcctccgccaggttcaccgtctcctctgcatcctctgtcagatgatacaattcatcctctccataaggataccgccggataaatttccactcttttgaacgaatcatccggttaggcccatactcatcgtaaaccaccacgggtcccgcctcctgctccgccccttccaaaaccggagtaaagcttcgtccgggcatacggccttccgcttgtacggatatccccgccatggaaagcagtgacggaaaaaagtcatactgactgtaaaggccgcggatcacgcgccccggctccgtatggcccggccagcgcacgagaaacggcacctttacggaggtatcgtacagattcagcggaaaggtggcatttcccttcccccacacgccgtgatgtcccatgttcatcccgttgtccgccatgaaacagaggatacagtgatcgtattctcctgtttcctttaaatgggccacaatgcgtccaacgcccgcatccatagccgtgaccgccgcgtaataaccgcgcagaagcgactttctcacttctcctgtaccgtacggtgccgtctgaatctgcctatcgctgacaggaaggtcgggtgtcgctgtaaatgcacagtcccggtaggcttccacatatttcctgggatgctggtcttcatcccagggatcgtgaggcgctgtgtaatgtacgctgatataatacgggttttgttccgccctgcatgcgtcgatatattccagcgccttatccgtaatcacatcggtgatatagcggctctcataccgtatccctccattttccacaacatccgccttcttgtaaaggcacccgcccctggcgattgtaaaccatttcgaaaagccgtgctgcgggtgcagactgtctcccagatgccatttgcccgcaagacagcatgtgtagccctcccgtgccagaacatcggtataggtggtcatcccctccagataaggtatggctctgtcctcatttctgtaatacgggtcgccgctcttttcctttagccgctcccggtccacattccccccgcggatccagtccagaacgccatgggcagagggcatccttcccgtgaagatcgttccccgcgccggagagcagaccggagaggcgcagaaaaagttctcgaatcttacgccctcctctgccaggcggtccaggttcggtgtcttcacatcccggttccccgcacagcccatggcccaggctccctggtcatcggtcagtatcataataatatttggccgttccatctttattcctccatatcaaagggggacccgggataaattgtccctgtcccccttactctatttttactgatatccgttttctgtaagctgtttactaatttctgccagtaaatcctcgactccgtttttgttcagtgcatctaaaaactgtggtatatagacctcagggtctaccataccggactccagcgctttggcattctcatccaccacgttggagatagccgctatctcggtttccaccgggctgttatccaatgtaaagccattgtgaggagccgttatggccttcgcattatattcctcaaataactgttcgatattatccgggtaggagatatcccacttctggttgaacggtgtgccgaactgccatccataggtgtaatcaacatagccgttgtcctcgatcttcagggttccgcccattgtgcggtctacctggttatcgcccaccgcgctgtagtgctggccttcaatgccgtgacggatcagggttcctacgtattcgtcggtatttaacaggttgatgaactccagggccttatccggatgttcggaagcagaggaaatagccagaattcctccgcgcgcgttctttgtctcaaagagcgggtccatgagaggaacgaaggtcacgccatgccccgtcttagccgcctcagcctcagccgctcccggagcgtatgaaatgatataggagaacagcttgccgttcttaaaatcattgtcgcggttggcaatgtcggtatcatagtttaccgggtccttagacatgtaccccgcctcataccagcttctcaccagtttacagtaatccatgtattcctgtgttgcatactgattaaacacccccgtctgatccttaaagtactcgtattccggcactgcggccgcacctggaagtgctctggagccggacagactctcgtagggatacagcatattgaaggagccgccggagcttccaaggccggaaagtccgatgacatcctctcctgccgcgtcagccttttccttgacggtctttaacacctccgtgtagtcctccagtgtctttactgagcttaaatcgatcccatacttttctgccatggtagagtttacaaagaaaccgctctgccatcccatctctttataggacggaacgccatagatctttccgtttacggaaacagccttccataaggactcaggaataaactcatacgtctcaggagcgtactgcttcactgcatccgtaatatccataaatgcatcctttgccacaaactgcacatagttggtcgtccagtctgcggtaaagcagatatcaaaatactcgccggagttgatcagggtcggcatcttttccttgtaatcgggattggcgatgaccgtataatcgatcgtcacgccgatcttttccttcgtatactcatttaatgccgcaataaccttatcggtatccgcatccaccggattcaaggacatataccattttaaagtaacaggctcctccgccgtcttcgaagcatctgtctctgctcccttttcagccgtcgtctctcctgctgccttcgtatccgcagaggccgccgtaccgccatccgtcgtctttgaagagccgcagcctgtcatcaggctggctgccattgccgcgctcagcaccgcgcacgcccacacctttctttttctcatttcttacttcctccttctacataatttataacagcttaccctttgaccccgccgattgtaagtccctttacaaaatatttttggaagaagggataggcgcaaaggataggcagtactaccagtacggttaaggccattcggccgctgttggtcggagcgttgtttgccatctccgcgtactccagcgcgttagccgagctctgtttcagtgactccaagctgttctgcatgctccataagaacgtctggatcgggtaattcttcgtctcgtaaatgtaaagcatgcccagaaaccagtcgttccagtaagcgatcatggtaaacaggccaatggtggcgattcccggtttagacagcggaagaacgatcttcaaaaaggtattgaattcccctgaaccgtcgatggtagctgcctccacaatctccatgggtatgctcttaaaaaaggtccgcagcaccaccacataaaacacattgagtgacatgggtaaaatcagcgcccagacagaatcccgaagccccaaaagctgtgtgttgaccatatagctgggaaccagaccgccgttaaacagcatagtaaaaagaagcagtaaggtcaatggctttccataccggtaatccgaacgcgaaagcacataggacagaagtgtcgtcaccgccaggctgaacaccgttcccacgatcgtgacaaacagcgtaattccgtaggaacgaaccacctgatcccccattttgaagaaaagccggtaggcctccagactccattcgctgggaaaaaatgtatagccattttcaaaaatgctctgctcactgctgaaggacacgataatgaccaacagaaccggcagcacgcaggcaagcgccatcaaggtcagaatcacgttcatgatcccgttcgtcttcttactgatatgattgacgcaggaatccgctcctgcttcctcgtctctatatttctttttcatggcaattcccctttcctgactaaaaattcccctttcctgactaaagcagccgctctcatgcggtcttcacgcgttttccgaagaatggctgtcagaacagcgcgctgtccttgtcgatctttcgcacaatgaaattggagcccagcaccagaataaagccgactacagactgatataagttggcggccgaagccattccgatgttgccgctgacctttaacgcccggtaaacatatgtatcgatgacgttggtgatcgggtaaagggggccggaatccctgggcagctgatagaatagcccaaaatcagagtagaacatcttgccgatcgccagtatggtcagtacaatcatcatggaacgcatacagggaagcgtaatatacttaatctgctgccacttggtcgccccatccatgatggccgcttcgtaataatcattggaaatccccaccagagagcctaagtacataacggtcgagtagcccacggtcttccagagctggcagaataccaggataaacggccagtactgcttctgggtataccactggacctcatcttttccgaaaaagcggagaatgtggttcaataacccgttatccacacttaagaatgcaaacgcgataaaggaaacgacaacccatgacagaaagtaaggcgccatgaagatcgtctggaagagcttcgcccttctcttatttaacagttcattgagcacgatcgccacggtaaccgctaccaccagatccagtacaataaaaatcagattgtaacatatggtgttgcgggtgatgatccatgcgtcgctggtcttaaacagaaacttaaagttttccagcccgttccattcgcttccgaatatcccttttctaatgttgtatttcttaaaggccaggacaatgccggacaatggcagatacttgaataaaatcatcaggataatccccggcagggccatgagcgtgagcggcaggtttttcttaaaatagaaccattcacttttttgccttgttttcattttttaccccctgtttcttcgcatcgctttttgctttgatgttttctggcataattatacctttatcggattccattccacaaggagactttttttatctcatgtgtacttttatttcggaacgctccgaaccgattgcgcggctgaccttcatgctttataatcatctacatagaaagtgaggaaaacaattatgaaggttcttcttgttgacgacgagatttttgcagtcagaggattaaactccatgctgcactgggaagcatttcacggtgagcttgccggaactgctgccaacggggaggaggcgatggaatatatggcagccactcctccggatgtcattatttccgatatcaagatgccgcggatggacgggctgaagctggcggagctgattcacgcacagtctccggccacccgcatgatcctcttaagcggccacggggagtttgaatatgcaagacaggcgctcaagtacgacgttgcagactacatcttaaagccaatcacaagagaaaaggtcaatcagatcgaaaacctcctgattaagttttacgaggaaaatcaggagaggaagcagcggttcttaaacgcctggaattccggtctggaagagaaaatattaacgatactccacaatcaggatatggaggcgctggatcagtttttccgctcttcctattttgtaagcaccatgcacagcagctccgccaatcctctgggaatccagctgatcaattacttatacgcctatttttcccagatcgatgtaaaccggacagtcattaccgtctcaagggagcgcgctatggaacagttctgggactctccgggtacccaggaaaagatcaacttcatcataaccagctattacgacgttctgaccgggatgaatcagaaaaagcaggcatacagcgagtcctttatcacctatgcaaaggagtatatcggtgaacattactctgacccggagttcaacatctccgtcctggcggacagtatgcacgtatcgctgtcctacttaagctcccagttcaagcaggccaccggttccaacctaatttcctatgtgaccgcaatgcgtatggactacgcccgccgtctgctggccgaccgccgttactccatcggggagatatccgcgatgtcaggctacgaggacgccagatatttcgccaagctgttcaagaaaaagacggggtttacccccagtgaataccggaatctgaaaacataaagaaggaggggtcccatggcaatccgaaaaaaaatatctggtctgtttctggctatcatcctcttctttctcttaaccttctacatatttatgtacttttattttcacaatacggtaacggccgcagtggtggaacggcaggaggcacaggtcatggcaaaccgccatctggcctctaattttatgaataatctgagacagatcaccatccattttatcagtgaccgcgccatcggcagccagctcagcagcacgtccaccgagcccatggagcagctgcaggtccgcgccgccctgcagtcccagttctctcactactcgctgcttacgatgtcccatgatgtcaacagctaccgctataccctcttcctcaatgaccagcttcccatctcatcgatgtttgaggccaggaccctgagcacgaatccctacagtaccgccagcagcatctttgccaacaccctggtgaaggacgatctgtggtataagaatactctggaggcctccaattacacctgcgtatttaataatgaaagttccggagagctgtgccttgccaagaaaatccagaataccagctatactggaccatactataaggatgggcaggccgtcatggtcatcagcattaaaatgccctatatcgattctgttttcggcgggattccccccacccccaacagcggctacgcccttctggacaaaaaggggcagcttctctacgccagccccagcggcccggatcacagcttctacacagaggcacttgcagcggtcagcgggaataccgccttataccaggccggaaccggttctcaccacgtaatcggcggggagccttacctggtaaactttgacgattccgatcaggatatcacccttctgtcgcttacgccctactccgatatcaatcgtacagtacgcccggtcatggtacgcttttccgtgatctctctgctgattacactatgtgccatggctgttattttcacggcttcagaccgcatcacacggccgattatcctcctttctgaggtgatcggttccatcaccgatacgagaacctttgacttaaagagccttcacgtatcgaaggaccgggaaatcgtcagtctggaggaaagcttcacgaagctgattatcaacaacaaccgtttgattcatgatgtccaggcgcaggaaatcaggcagaaaaactcggaattaaaggcactgcaggcacagatcgatccccattttatcttcaatgcaatggatgcggtcaactggattgctctgacccgcgatcaggatgatctggcggagatcctcgcctccattgccaatctcatgcgctacagcatcatggaggccgaccagctcatccccttaacgaaagagctttccaatataggagaatatattgcgatctacaagctccggcatcagggagatatcaggctttccgtcccctcaaaagacgcctcagccgatactctgattccaaaattcgcgcttcagcccctggtggaaaattccatccgctacggcggccagccgacgggaacggcgatcgagatcacggtctctgtaacacatgaggcggaccgtttcattctggaggtatcagacaacggccagggctgcgatcctgatctgctcaatgagtatctggcttataaaacgaacaacttaaaggtgaccaacggctttggaatccgcaatgtgaacgaccggatacgccttcatttcgggccggaaagcggtcttaagtactacgttgatgaaaacaacaggctgacggcacgggcagaatttaagtacagggaagcttccgctgctaaattataataaaaggagaaatttgatatggagaagaaaacgatcgttaagaatgagattgtaaagaatggaattcacggctattcggcggcagagacctacatagcgccgaaagagcccgccgtaaaagagcatctcgaatggttcatgggattaaagctgggcctgatgatgcactgggcgcctggctgccagatggggacctatgagtcgtggcccctctccgacggagacggcagctggtctcagaaggatgtggactggaccgatatagagaccttcaagcaggagtatatcgactgcaataaaacctttaacccggtgaaattccgcccggaccgcatggcagaatttgcaaaagaatgcggctttaagtaccttttattcaccaccaagcaccacgacggcttctgcatgttcgatacgaagaccaccgattataaaataacagatccctcctgccccttctcctctcatccggattccgatatcaccggggctctgtaccgggaatttaaaaagcagggactggccatctccgtctacttctccaagccggactggcacagcgatgcctactggcataaggcattcggcaccgcgcccaccagaaatatcaactattccgttacagaccatccggagctgtgggaggaatttgtagattatacccacgcccagcttcgcgagctgacctccaactatggaaaagtagacgtgctgtggctggatggcggctgggtcaacgccgggaacgaaggccaggatatccgtctgaatgagattgtcaaagagatacgcagcaccacacagccccatctgattgtctgcgaccgcaccgcaggcggcgaatatgaaaatatcatcacaccggaaaaggaaatcccggacgcgccgctcttcgtgccgtgggagacgtgcacaacggtcggtgaaaaattttccttccattacacagactgctttaagtccggccgccagctggtacacctgctgctggacgtcgtatcaaaaggcggaaatctggcgctcaacgtggcccctcagccggacggacttctgccggcgcctgccatgtcctctttaagagatatgggcaaatggctggccgtccatggagaaggcatctatgagacagaaatcacggcaccctattatgaaaaccgggtaaagtatacggcaaagaaagataccgtttatgcattctacctctacgaagagactgcagccctgccttcgaagctctgccttcaccttccggagctccaaaaacagattgcctcggtaacactcatgcggactggagaaccggtggactataccaccgaatttggcgcactgatccttcatctgccgctggagtcagccatgggcggggaatatgcggactgttttgttatacgattttagcggctgatggtattctgcggcagaaggaggccgggagcacaacttcatgctcccggcctccttctgccgcagtgttttcgcacacgctaactccgcttttcctccagtattttctctgcttcttcccatattgcgccaagccgggcttctgcttctctctcgtcctttcctctggtccctatgtaaatcttaattttaggttctgttcccgacggtctgatacagagccagctgtcgccttcgagttcaaaatacagcacatctgatattggaagaccagtatcatcgttaagataatcacgaaccttgacggttttgagacctccaagcgattttgggggattattcctcatattttccattaagcgattcatgaatgccgcgccatccgtacccgttttcacaatggtatggatactttctttataatacccgtatcgtttatagagcttctgcatctggtcccaaagggtcagccccttcgtccggtaatagactgcagcctcacacagcgccataacagcccctactgcgtccttatctctggaataagtgccgacgaggcatccatagctctcctcaaagccaaagagatattcataagtaccctgtttttcaaaaaggcggatctgttccccaatatatttaaaaccggttaatgtttcaatgagctttaccccgtattcccggcagacagcacctgccatctttcccgatacaattgtcgtaaccaccgcaccgcattctggcagcgtatttctctcttttctgtgttccaaaaggtattcgcagagaatcataccagacatattgccggtaaatgccatatagtttccagtctcttcatctctggcatatacgccaaggcggtctgcatccggatcagtcgccaatacaacatccgcccctgtctcctttgccagctcaagcgccctggcaaatgcccttttatcttcaggattcggagattctacggtcggaaaatcaccatccggcagcatctgatcctctaccacatataccgattcaaatcctaattcctttaaaattcttctgaccagaacatttcctgtaccatgaaggggcgtatatacaatcttcagttcccgtgccctttctcttaaaagctccggctcctgtacaagctttttaagctccgataagtagcggcagtcgatttcctccccaataaaatgtaagagtccgccgcacacggcttctctctgccccatatatttcacagaagcaaagtcgcttacagcctttacttcacgcataatatctgcatctcttggacaggtaatctgagcgccgtcctcccagtataccttatagccgttatattccggcggattatggctggcagtcacaacaatccccgccatacactggagttctctgactgcaaaagataattccggcgtcggacgaaggctgtcaaataaatatacctctatgccatttgcgcagagacagagcgccgcctccatggcaaattccgccgagttatggcgggaatcataggcaatgactgcctttctttccgtacattcctgactgtttatatagtttgcaagcccctgcgtcgccttcctcaccgtatagcggttcattcggttcagccccgcccccatgattcccctcagtccgccggttccgaattccagttccctgctgaagcggtccctgatctcttcctcgctggtaagggctttcagttcttgtcttgttttgtcatcgaaatatgaatcttcgcaccatctgcggtactcatccctgtaatcggtcatttcttatctccctgtttccttatatcagtctgcccggcatatgactgtactgtggtccggcatcaatgaatacatactgcgcacatacagcccttccatacttccctgcagcacctgcacacgtttctcccctgcgtccatatcaaaatagttgtcggaaagcagcaaatcgccggcctcgtttccgatttccacacctttggcgaaggctgctgcatggatcagcagagtctccccatccctgcgcagttccagcttcggatctgcgaactcaaaatgttttgggggaacaaataagctggcaccatgcgaaactttttccccataaatccagagatcataggacaaataatggtttctgatatctatatccggaaattcaatccacggatagctgcagacagaaagcgcttccacctccacactgtactgtccctgccggcagatgtcagacgccgcatcctgaatgctccatttgataaatccgcttaccggctcccttgtctcattggtcacacagaatcgggccgcttttctgatgcagcggttctcctcatttacattcatggaggaactcagagcgccttcttcctcacaggaaagcaggaccggagcaaaaaaacgcctggcgaaatattgaagcgccttccatctgccgtagtaatcaatggaggaccaggaggccaccggccagcagtcatttaactgccagtagacacagcccatgcaccgcccccggttcctccggaaatgttccacaccataccggatagcctctgcctgcagcagctgcgaaacgtaaacgagaagctccagtgattccggatacggatacatctggctcatatactgaagtatctttccattagccccggcatttctctgatgtttttccatcacataggagaaaatatttctgtcctccggctcagtgaactgttcaatggtctttaccgcgggaaatgactggaacccaaattcagagagatagcggaaatagtatttcctgtaatccgtaaacggaacgcctccatgccacacttcccagtaatgggcgtctccgcggttctcatcgttgggctgatcgaaatccccgcccgatgacggactggacggccagaaaaaggtatccggatcaagctgcctcagtaattccggtatgattctttcattcataatcaaatattcggtcttctgcagcggttttctcacccattgattatcctcaaggaacatttccatctcattgttgccgcaccataagcccaggcaggcatgatggcggatgcgccgtacattatcccggatttccgccgctgtatttgcttcaaactccggcgtcagaggataaaccgcacaggcaaacatgaaatcctgccatacgatcagacccatttcgtcgcacaggtcatagaaaaagtcatccggatagtatccgcctccccagacgcggatcacattaaaattacagtttctgcagtgttccaaaagcgtttttgtccgttcccggctgacgcggccgcggatgcagtcctccggtatgtaatccgcccccatggcaaaaatttccacaccgttcacttcatgggcaaacttattcccatactcatccgccgccgtattgaccgtcattgttctgaggccaatctttcggctccagctatcctgaagctcaccgtctgcagccaccatgacttctacctggtatagaggctgttttccataaccattcggccaccacagttccggtttttttattgtcacagcttttgaaaactgatacttttcgccttccatctggtacgtaatactcatcccctgcggatctgtgattctgagcatacaggagcaggccccatcatcggccgcctccacagtggtattcaaggacaggatcacgcttccgccgctgtgcctctgtctgatatgcacatcacagatggaggcctgattcacaccaatcagggatacctcccggaacagaccggcatccggaagcctcggtccccaatcccatccaaaggagcagtggctctttcttagaagcggaaagccctgcatagcctcgggtgcaccgtcataaggagtcttttcataggcctctctgataaaagacagcggcgaatacaaatgtaccttaattttattggtctctcccatcagagattttaccggatactcccatatgcggtgcatattatccgcatgtccaagataaaccccgttgaagaaaatatccgccagtgtatcaattccttcgaatctcagccggatatccctgcatcccatcagagcttcatcaggcaacagggaaatctcatattcgtagtccccatccatcatggccagcgcggcctcctcacagtctctccagtaaggatccttcatcgctccatgctccagccaggttccatatacggttcccggtactttcgtttcaaaactccggccggtggaacagcatcttaagttccagccatctgtcagtttctgtatcatcttcatttaccttatcctcatatttccagaatcacacagcctccgccaggaactaacattcggaccattccaggcttcacacagtcttttccgtttttttccctagttctgctatccggtacgctgtctgaagcgcagagaatttgccatcggtcttcaacagggaccgtcaccccgcaatccgaaaaattaatcataattcgtacccggtccattcccagcgctctctcgatttctatcaagccgttccccagttttcgcagttccattgttccttctgtcagcgccgcagttctctctctcagttcaatgaaatttttgacgaaattccagatcgaggacggatcctctctctgtttttcagcctcgtcccaatccataggattgcgggaggcatcccgtgatcgttcattcagaatccgaaccgcttcctccctgctttttccctctttaagagccgcctcataggccagtattccctgaacatcttttgcgtcgtccacagaattcagaatacggcttttcattccgatttcatctccaaagtacagaaacgggattcccctgcaggaaagcatcagcgccagcaggcatttcgttttcccttccgaaaatccgaaccggtccggaaaacgtctcatatcgtgacttccaaaaaacagggttggatattctgaatccccgtacagttcctgcatgcgctttaactcttcatagatctcgtcgagctgaaatatttccctgcttcccaaattgaaattaaaagtcgtgtccaggctcccgccgcccgtataggaatgaattctggttaaatcgtcgctgctgatctctccaaccagaaatgcatctggcttcttctccctgatcctgcctgccatccgtttgatagccgcctgaaccccgggttgattgacatcattttcatgaagctgttccccgtttcccgtaaccggattatccgccagagagccggacaccgataagttgttaatcacatcaaaccggaaaccatccacgcctttcagaagccagaaatcaagaacctggtaaatggcctcctccacagaaggattctgccagtttaagtcagcctgctcctttgcaaaagaatggtaatagtactgtcccgaatccccatactccacatactcccatgcgcttcctccgaaaaaggactcccagttattcggctcccctccgttaacgggatccttccagatataccagtctctctcactgctgtctttggaggcggctgattttataaaccacgggtgcaggatcgatgtatgattcaaaaccatatcaatgatgaccctgataccatgcttatgggctgccttcaccatctcctcaaaatcttccattgttccgtaatccggatccacaccgcaataatcggaaacatcgtatccgttatctacctttggagagggataaaaaggagtgagccagattccgcccactcccagttctttcagatacggcagcttcgaggtgatcccccggataccgctcttcccgttctgaccggtgtcacggaaggatcttatatatatttcgtaaaaaaccgtatttttccaccactgattcatttatatgaactccctcactgaatctctttcaatcagctggacatccagcaccagcttttccaccttttccttcggccgttccatacattttagaagccgttccatagccttttttcccattaggaccttgtccacccgcattgtcgtaatacggggattcaccatattgctcagttcaatatcgtcgaacccaacaacgccgatatcttcaggaaccttgaggccgcactgcgacagagccttacacataaggattgccatcttatcattagaacagatcagcgcttccggcttatcctccagtgactgatagtaatccgcaagactggacgcgtcctgatgaatcaccgcgtcctccacattctttaaagcggaataccgtctgataaaggcgatcccttcttcaaaggatggaaatttaagatattgctgcatggcctcctgatatccccagaaacgttcccgaatgctgggggtataggagagatcaccgaaaaatccgattttccggtagcccttatccagcagatactttgtcagcttataggcgcccgccacattattggtcatcacacagtcagtaggtgtctccacagattcgtgatccagaagcagaaccggtatggagtagctcttcaaacgcttcagatactcctcatcgatcttaccaacgacaatcagtcccgacaccttctgctgttccacacaggccggtatctcctgattcttctcgaaggaattgataaacagatcatacccggccttctttgccgcttcctccaatcccagcagaatccgtccatagaactgcatatccttaaagaaacggtcctccagaaggatacagatgttcttattggagtatgccgccgtatacttggtactctgatccagatatcccatctcttccgcagcgtttaaaacaagccttctcgtctcttcgctgacccccgcccggtcattcagcgccagggataccgcattgacagaaaggttcagcctttccgctatttccttcatggtaacccgcttcttcatactgtattccacctttctgactttatatggccttcagcccggccagtaattgggaaaccgagaaatctgctctgcatatcttatcgtccgcggcgccgtaatagagagagacgcagtctccttccaccagacagccacaggtaaataccacatttccaaagaagccttctgtctcatatgcagcttccggttccagaatcggtgcctccgtctttgcgatcaccctggaaggatcgcttaaatccaggagaaatgcccccaggcagtaccggtcattcctgtcggcggcatggtaaattttcacccagccctgttccgttttaaacggtacggctccgcctccgattctcccgttatcccagctgtccgcatcggatatgccgcagaaatgcttctgatgtccccagtgtatcagatccggtgactgggccagccacatctcagggttgccgattccgcctggtacgggacggttaaacgccatatacataccattaattttttccggaaatatggtaacatccttattctccggtgcaaatatgattccgtgccgctcaaatgtctcaaaatcccttgtactgattaacgaggtagccgctccattttccgtcacagaagtataattaatgtaatacacatccccgatctgagtaattctcggatcctccattccccagctctcctcctccgcacaaggaaaaatagacggagtatcctccacagtaaaatgaattccatcctttgatctggccactcttaaatgggacagagatgttaaatacaccgttctcttcccctgcctcatcatcttattaatcgttctggaatcggtaaaatcgagctccggatgttccgcttttctcagactgagtactgtaatctcatcttttccactgatcttactcacaacagggatccgtacttctccttcccctgctcctttaacagactcggccactctacacagcaggatcacctcatctttatattttgcgacgccgcagttaaataccccttcgactttaaaatcttctcggctgggttttacattttccgggataagaagcggattttctccgcatctttttacttccagcatgttgttcctcctcattttccattatttaagcataaagctgattccctctttgaagtatttggaaaagcataaaaacaggataataatcggcagagtcagaataacagacgccgcatacatcggtcccggaaatgctcccatcggtttgaactgagtggaaatcaacacattaagcgtctgcatctgaatgtttggcgcgatcagcatatcccacatcagctccgaccaccgctgcataaaaatagacagaaacacaattgtggtaaccgattttgttatgggaaacgcaatataaaatataatgcgcagctctccggcgccgtctatcttcgcagcctcaaaaacctcattaggcaaggttttaaaatagttgatatacatgaaaatggcccaaatggaaatgcacatgggtatgatcattccgccgtacgtattcgccataggctttgcaatcatatacctgggcaccagcaggattatggttgggaaaaacatctgaaacagcagggagtccataatgaaacgttctcccttaaatttcagtttgcatacggaataaccgttgcacagtcctatgatgaccgatatcactgcggtaggaaatgctacaaggaatgagttgatcagggcactgacccacatcatggaattcgtcgctccgccctttcctatcaaatattcatagcttcttaacgtaaaaccgtgaggcaccatcaccttatcgacctgatcccaggaggtaaaggactgaagcaccatataataatagggaaacagggatatcgcaagcagagtcagggtgactgctgtaataatatatgttttaacacttaatttcttttttcttcccatattcttttctcctcgttatcgttgcctaccatccgaatcttctgttcagccggtccgttacagcgttgataatccttaaagtgataaagatctgaaccgcactggctatcgccatggccgccccatatccggactggaatctggtaaaggacgtgttgtaaatttccagctgccatgtagtcgtcgtcatgttagggccgccgcctgtcagcagatacggctctgtaaagacgccgaacgccaggcctgtggccagtacaattacggtggtcaacgtaggcataatcatcggaagcgtaatgtgcaggagcttatgcagtccggtcgagccgtccagcatcgcagcttccgtcacatcatcccctatgctttcaatgcctgagagaataaataatgcatagtaccccgacattttccagacaacaatacccaccataacggcaaatgcgtatctctggtctgtcagccagtttatattcagattaaactggtctctcaaaaacgtattgaacgcagaattataattaaaaaagtactttacaacaacactcgtcgcaaccccggaggtcagataaggaataaagaataaaaccgccaccagacccttgattttatccggcagattggataccagaagtgcgatgatcagccccccagcaaagcacagcactacaataggcaggaggtagcggtaagagttaataaaagccgcttttaccctgctgtcggaaaaaaggccggcaaaattcctgatccctacaaacgtcttctgttccgacatcaggttccagtccatggtggaaagccagaacgcccagatcagcggaatcagaaagaaaataagggaataaatcaggtatggcccgttgagcagccatcccataaggccagcccttttatttcccgtaatactctttctcttcataaaacccctcctttttgggagggacaggaaagcgattcctgtccccgatcaacagcctattccagaccacccgcctgcttcatggcctccatagccgcctctacatatggggtggcatccggtgcatttccaggctctgcattcataacttcattcatatacggcgctgttccgctctcggtcagtgctgtctgtatatcagttaccttttctgtcgcaatactcggaatcgcatacggcacagcttccgccagtgcagctaactccggatactctttcataacgtcggcaaatatttcattgtcatttaaatcacctctgaccggaagcatcgtcgtggcgttcagccagtcaagatcggtctgtgcagaattttccttattataaacccactttacgaattccactgcgccggcatgttcctcatctgtaatactcttatttttatagaagacaaggcctttggaatcagcaaagttataaggaatatcaccatcattcttcacaattgcctgtccgtaaatataatcttctccgtagaccttattgttttcacgatagagtgaaatctcccatggtgcgttgattgtcacgagtacggaaggatttgcctctgtccagatgctggatatttcgccggattggattgaattgccaaagaggccaatcagttcaaacgcttcgactgcgccttccttatcgagtaccagtttattgccctctacccacggttttccccctgtcagagcttcgtaaggcatctgaaaatcataccatctgtcccaccactgatccggacgggttaaggacggacggtagaaggaatgggtaacccccatctctttcatggtggtatcacgctgcgcggcaaattcggtaatgacagctgtaaattctgccacggtcttcggtgccgaatcaaagcccagagcctttaaggctttcatattccactgccagatcatcggattgacatagaccgggagcacatactgtttcccgtcaatcgcccagtttgtgatcgtatcttccatctttctggcctcaatcacatctgtaaaccaggtttcgccagacaggtcatagactgctccggaagctgccagagttgctgcgaatcccctgttgatattttccgatacagccggtacggtccctgttgcgattgcattctgaattcctgcttctgaagacggggattccggcatctgctgaacttttacctctatcttttttccatcaaccgttatgcctgcttcgttaaacgcctgtgccttggattcccagaagttatactgaacctgctgaggcgccgtccagaaatcaacggaaaccacctctccggaggcgcccccatgattggccgccggctcattacctcctgattttccgcatcctgtcatcacggatgcagtcatagccgccgctgctgcaattgccactactctcttcattcttttcataagtctcttctccttctatctgttttcatattcatcaaatggatcgtcgatcagcaccttttgtccttctgcatcgctgactccgcagtacaattccgcttttcctcccccgagcctcacaagcccgccggaaaatataacatcttccaaatccggtcttttacttggtcccggctggaaatttcttcgctccgcaatcagtttcataggaccgtattcccctgtctcaggattgaagcagaacgccgtggaatagtaatgccggtttccttccgtgtcaaatcctgcaatatgggagagcactccgatattcccgcctgctatgcggtggagttcatttgctccgccccattcctctggtataaactgatgttccataagcgtcgcctgctgcaggctttctgcatctaactcgtccagactttcaaagaaacggtaaccgatctttccgcgtcccccccgttccccctgtggtctggtaagtaccagaatccttccatcctccagctcacagagccggatatccttcatccggtctggccccacagcaaatctgctcaaatcaaggattccatccccccggtaaaatacagtcctgtaatttaagtatcctggccgttcctcatcctcgaatacttccacgcccccaaggaccagtttcccgccgatcctcgtcacaaatggatcctgaaggtttaaggcttcccgttctgtttccacccactcgccttcgctctcttcgaaaaagccaatcctggaatactcactgtctctcgcctcaacccgtcctgcaatccaagtctttccatctgcaaaaaatggtgctgtgatattatagacgtcttttccgttctgcttgaggataaactttattttacttgaatttacttgaattttctctttattaaattcaagcagcagttctttgcacgtgcgtagggtattatctttttgttgtaacatatgtctgtttttctcctttcttattctatttttctaatgcttttgtcttgtttgtcttgtctatggcattatattattcctgcttttacttgaattcaattataatttacttgaattctacatttatattttaaagtgcagaatcttgatactgtcccctatccattaaccaaagaaaagaaggcggttttcacaaaatgtaaaaaccgccttcatacttcaattcattttcatcgctgcagcaatctcgaatactaacaaaccattagaccaaccggttcgcccccgccgcctccccattttccctcagactcttctgccatttacctgtatccgccgctatattctgtcccttcaattttctgtattgtttggggcttaagcggtacttcttctgaaaggtatacccgaaatgctgccggctgttgaaccctgcctcaaaggcaatgtccacaatattcatgctgctgtttttcagcaaaaactgggcccgctccaaccgctggttattgatgtactccataatcccgcatccgtaggctttgctgaacagtgtctgcaaatacgaatgattgaggctgacgtatttcgccacatcctctacccggatatcttcccgaaagtgctcccggatatatttccgggcttttttcagatgaaccatgccggttaccccttcattatcctgaatgcaccttgaccactcaatcagcattcgttgaaagatcagatccagtaaataactgtttcgatcccgtctctccagctcggaaatcaagtccttcaatacgtattccatctttccgtaatcggtgagcagcagatacggctccggggataccatcagctccgcgaagccggcatccttttcggccaggctgtttaaatccgttccgcccatcttatccagacaggaaaactcataatttaacagtacactgcgctctccctgattgatttccagcctgtgcggaattcccggacggatgcagataaactgccgttcctccatttccaccagaacgccttccacctccacccggcacgtgccggttaccagatacatgatctcccactggtcatgtctgtgtgcctccatctgaaaataatccagtgccaccgcataatatgcggccggatatgcataacgcggatatgcatagcgcggatacgcataactcgccattgtattatctgccatagccttccctctttttccgtatcattcctctcttttattgtagcatatcgttttctattcatccaacaatttattgcatttgagaaaaaggcgtttcaatttcatgcgcatcctcttcgaagaatctgtatactacaatcaaagcttaactgagaaaggggatacaaacatatgaaattcaaaattgcttttatcggtgccggaagtctgatttttacaaggacactgttcacggatatcatgtcagttccggagtttcgggacatcgatatcgcgtttacagacatcagtgaggacaacttaaaaaaggtcaccgacttatgccagaaggatctggaggcaaatgggattgcaacgaagattcagtctaccatggaccgcagagaggccttccaggatgccagatatatcattaactgtgtccgcattggcggactggaagggtttgaaactgatattgaaataccgctgaaatacggtgttgaccagtgtgtcggcgacacgctctgcatcggcggaatcatgtatggacagcgtgtcattgccgccatgctggacttctgcaaagacatccgggaagtagcggcccccggcgccatcatgctcaattattccaatccaaacgccatggctacatgggcctgcaacaagtacggcaaggtgaaaaccatcggcctgtgccacggtgagattcacggtgagcagcagatcgccgaagtacttggcgttcccagagatgagctcgatttcgtttgtgcgggaatcaatcaccagacctggtacatatccatcagccatcatggggaatccatgctgcaaaagcttcttcccgccttcgaggctcacgaaacctaccgggaggaggaaaaagtccgcatcgatatcttaaaacggttcgggtattattccacagaatcaaacggccacttatccgaatatgtggcatggtacagaaaacggcccgatgaaataaaggactggatcgatttaagccgttggatccacggagagaccggcggatatttacgggtaacccgggaagaacgccgctggttcgaaaccgattatccaaaaattctggctgagccgccgaaaaaatacgacggctccgaccgcggcctggaacacggctcctacatcatcgaatccctggaaaccggacgcatgtaccgcggccatttcaatatgatgaacgaaggctgcatatccaatctgccatatgaatgtgtggtcgaggttccctgctacgtagacggaaacggcatcagtgtaccgaaaatcggtgatcttcccctcggccctgctgccgtatgctcccagtccatctgggtacagcgcctgtcggtggaagccgcggctgccggagacgtcaccctcctaaaacaggccgccttgatggacccgctcactggcgccgtctgcaatccgccggaaatctggcagatggttgatgaaatgctggtagctcaggagcagtggctcccacagtacaaagacgaaatagagcttgccaaaaaacgcctctcctcaggagaccggattcctaccagagacggataccgtggtgcggttcgcctccgtgaaaagtctccggaagaggttgccagcgccagggcacaaagggatttaactgcgaaataaaacaaaaaaagtcattcttactccccaaaataagaatggctttttttaaccccttctccctccctgcttcctcccacctgcgtagcagcaatcaaatcttccatcccttcctgccccagctgatcacagagcgcaacaaactgcttaaactccgggctttccattttatccttatggcaggccagaacaaatcttctcgcaaacacaaaatcatttacctccactacgcggaaagtcttatccgccagttccttttgaatcaggaattcagacataaccgccagaccggcccggtgaatgacggcctgctttattccttctatgctgttgcagcaccagtccattttcagagacagcccgtggctggaaaatacctgtttcaaaagataatccgtaccgctcccggactccctcccaacaaatgtttccttttgaagttctgttaaatccgtcttccgtccagcttcagccagaggatggccattccagcagatgaccgccagacgatcctttaaaaacggacggtatcttaaatacggggaggcatccgtctcctgaataactgccagatccagctgtgcatgcagtaatttctcctccagaacccggctgttgttaatttctgcactgacatggacatggacatcgccgcacctctttctgtacgctgcgagcagcggatgcaaaaggcagctgccgatagtggtgcagactccgatatttaacgtgggcaccgtattccccagtttcatagtcttttccatctgcgaaacactcttcagcacctgggaagaaaggtagagcatctgctctcccgcttttgtcaggtacagagaatggttcagacgctcaaaaagtatggtctcatactctttttccagcgcggcaaccgcctgactcaccgaagactgggaaatcatcagtgactgcgccgccttgctcatattcatttgtttacatacctcaacgaaaatctccagataacggatggtcatatctcacattcctttatgtattagtaaatacttattataatatcattatattcatatttttcaataccaaaaggccatgttatgatagagaaaaccagaaaggcaggaaatgacccatgaagaatcgatattttgtactggtaatcgacggctgtgccccggaatatctgactccggacactgcgcctcatatcttccggctggcggaaacatacggttttataaagaccatcaagtctgccataccgacggtaaccaatgtaaaccatgcgtgtattctgtccggcagatttccggaagataccggagttaccggcaattactattataatccggacaccggcgaggagggcttcgtggaagaacgcggttttatgaagataccgacggttcttcacacttgtcgtgaaagaggcttaaaaactgcgtttctgactgtaaaaggaaaggttttaggtgtgtacggagaagacgcagatatcggaattaacgcacaggcgccggacctccgccagctggaatccctggggctggccatgccgccaggtgtaagcgatccggcctgtacggaatggatcatgagcgcggcgctcgcatgtgtcaggcaggaggcccccgatttcgtatactgcaccaccaacgactgctgttttcaccattatggcccggagacggaagaagcccggcagcagattcaatggattgattattacatccatgaaatacataaagccgatcctcatcgccagatctacatcaccgcagaccatggcatgaatcagaaacaccgtctgctgaacgttcagaccattgctcagaatcatggaattcctctgttctgtctggctcctctgaaagacagatatattgaaaatcaccgctatcaggaaggaggaatcctctatctctacctgaacaataactcagacagggaacgtctgtccgcgcttatggaaagcattcccgagattgaaatgatcttacccagtgaagaagcggcccggcgctatcacctccccggcgattcgattggagactacgttgtctttgcggcaaaggactgtgcttttggggaaatcgacggagagtatctggagacagattccgtcagaacccatggttccctctgggaacaggaaatccctctggcggcggtttttccggccatgccagagggattctaccattacagcaaagatattgcggcgaatctgcgtctttaacagcgttccgctgcatactgttcataagcgtctgttcccgctttcaggcgctttagcccctcctccactctcgacgcgggacaggcgatattcatacggagaaactggtttccatgcccgccgtatgcggcgccggccgacagataaaggcccgtttccctgcggagataacggcacagctccgccgcgtccccaagcactcgtttgcagtccagccagagcaaatacgttgcgtgggactgcacaagagaaacattgggcagttcccgttccaaaaaggcgctgacgatccggcggttttcagccagatagtttctcaaatcgtccagccattcctctccctgtgtaaatgcggcaatcgccgcgtcaatggcaaatgcattcggttccgccacctcatcgctgtttaaggcccgctccatcttatgccttaagtattcgttcggcaccgcaaccgccgccgtctgcagaccggccagattaaaagcctttgtcggagcaatgcaggtaatgctgttctgtgcgcattcctctgacaccgatgcaaatggagtatagccgtatcccggctcggttaagtcgcagtgaatttcatctgaaatcactgtaacatgattggcggcacacagttccccgattcttcccagttcttctctgctccagatggatccggtgggattttggggattgcagagaagcatcagtgcagtctgaggatccttaagcttgttctccaggtccttccagtctatcctgtagctcttcccatcgtataaaagccggttttctatgaccctgcggccattattgcagatggaattatagaaaatgttatagaccggaggctgtaccagcacagcttcccccgctgtcgtcagtttgcggaccgcgctggaaacagcgggaaccacaccggcacagaatacgagccaatcccgatccatttcaaagttatggcgccgctgccaccatccggcgaccgcctccctccaggcctccggcaccgtggtataaccgaagattccatgctccgctcgttttttcagcgcttccgtaatctccggcgcggtttcaaagtccatatccgccacccacatgggcagttcccgttccgtgacatcccattttaaagaattacttccacgccggtctgtcaatcgatcaaaatcataggacatttacaccgcctccctcagttcctgcatctgaacaacagtttttgtcacatccactctggaagcatccataaccagctctttgattccctgcgcccttattctgccgccgctgggatttaagacactgtcaatcgtattgttaatctccgcgtccacggtggagtattcaaaggccagcgtcgtatttaacagacgacagtttttcatgaccagattgtcaatgtagcacatgccctgactgctctcaaccgtgcagttaatcagggtcagattctttgcgttccagcctaaatactcaccggagataaaggaatcataaacggttacattttcactattccagaacgcatcctttgagagcagccttgcattatggatctccgcctgttttacaccgtcaaaagagtaatttcctgtcagttcaaagccgtctatcaccatattcctgctgttcatggcgaagtaatcgcctcttgccgtcacctgattcatggtaacccggtcacaattccacagcgtctcccctgcgttcggcatggttacgtgggtgagacggatatccgacgcgcggcgaaatgtctttggcgcatcgatggtgcagtttttcatggaaatattctccgtataccagatcccggctcttcccatttcaaacagtacacagtcctccatcttaatgtcacggctgtaccacaacggatatttccacttaaacatgctcccatacaattcaatatttctgctctccttcaaaggggattccccatcggcaaaggtcgtatcgcagattttcaagtcctttccctgaaataacgccctctcacccgttaaaaattcctgttttataacattcatcctgttttctgttttcctttctacttttcatcggcttccatcccccggattcctccgcaccgttcttatctgatcggaaggtccagctcacgaatccacccagccacatcctccgcggacaccgcgctgccgaaccgggttccatcgtaccagacggcgctgtcagagcaggaacctttgagattttcggcacttgaaccgatcccgctgctgccggaggtacaaaacggcactaccgttttccctgagaaatcatagctttccaaaaatgtattgatgattctgggagcctggccgttccagatgggataccccagaaatataacgtcatattccgacaagcttaagtctgtgctgcctttagtctcctgccctgtgactccactgggggaaatagccggacggacagaagcatccttctgctccaggcttgtgcggctggtgctgtcacgatagtttaaatccgcttccgtatagggctttgccgcctttatctcataaagatccgctcccagaagatccgccgcatattccgccgcctttttcgttgttccggtacaggaaaagtacgcaaccagaacgcttttttctgacggttcatccacctgtgctaccgtagtctcttcctcagtcccgcttacgcttttcacctgcacaggcacggtgtctgtggacacagtcttcacagccgccgctgcatctttttggggactgcatgccgccagaaagcacatcaatacaaataccaggccgataacagctctatattttttcatccttccacctcttatctgtaaacttatctgcaaacttatctgcaaacttatctgcttaacgaataattccctcaaatcgcatttcactgctcaaaccggatctcatgaagccggtatacctcatccaggcttcggatcgcgagtatcatggtgtcacaggtatccatatctctgattttctccatctctgcatccgcaagctgaaagtcatccaccatgaaattctcctcaatacgctcccggtgtacagactttggtattacagcgattccttcctgaatgaaccagcgaagtatcacctgagccggtgtcttatgataaacactgccgacagcggccaaagtatcattttgaaagactccgtttcttccctccgcaaacggagcccaggccatcgtcctgatatcgtacatttccatcactttccgcagttctctctgctggcagaacggatgcatctcaatctggttcactgccggcatcacctcatgactcaggattaaatccaccagacggtcggcctcaaaattgcagaccccgatcgcctttattctgccgtcacggtacaattcttccatcgcccgccagctgccgtgataatctccatacggcatatggatcaggtataaatccagataatccgtctgtaaattctcaagcgtcttttcaaaagaccgtatcgtacggtcataaccggcatcctgtatccagaccttggataccagaaacacgtcctctctggcaattccgcttttcaaaaccgcattgcctactgctttttcatttccatagcaggccgccgtatcaatcatgcggcagcccgtctttaaagccgtcaaaacactttcttcacactgcttctgatctgtgatctggaaaacaccgaaacccatctggggcatttcagtaccgttattcagccgcaattttctcatcgcttgcacctctcctgttctgatcctgcaatcttcactcttgtgccgtctcgttttctcccgtaattaaaacactccccgataaagcttctataaactcctcaccggatatcaccgtgcccagttcatataaactgctgcccttcccgaaatgatcatagaacatcaccacatctccccacggtgcataataggccagagttcctttcccagcatccgccacaggagcgtcagaagcatcaagctttccgggtgggtaaaatattttttcgttcgtgctgtaatcttccacttcaatcgtcaggggaagctgtgcatataaatccttcgccgcctggctgccattcagcccataaacaattgtgtttccatttgatgtaacataaactctcatctgcgcctctcctttatccgccgattcctcttcctgaaaaacagactgcgaatcagccgcctctgccctgctgcatccacatgcggcaaaaaccagcataagcgcacaaaaaaatactgctgtatccctcatcttatgattacggcccctttcttaacttgttggtaactataagtaatgaatggctatctgtatcatagaacagtttccgttaaatatcaaatagttatgtagaatgcttttccatagctaaaaggaatgttactttaccttctgcagatagttgactgaaatggtattttcctgctatgatgaaacaaaaggggtgattccatgattgaaataagactgctttcctatttccttgccatagcaagagaacagagcataacgaaagccgccgatgctctgcatattacccagccgacgctttccaaacagatgatggagctggaagcacagctgggaaaacagctgctcatacgaggaaagaaaaagataacgcttacggaagaaggcgcctatctgcgaagcaaggcgcaggaaatgataaatttgatggaaaagacagaatcggcatttcacacggacgaggagctgatcagcggtgacatctatatgggatgcggggaaactccggctatggaatttatcaccggaattttcaagggaatccagaatgactacccgcacgtccattttcacatattcagcggagacgccgaagcggtaatggaacggctggacaaggggctgttggatctgggacttctgctggggcccatgcagcatgaaaaatacgattatctgaatctggcgagaagtgacagctacggacttctgatgccgagagactgtccgcttgcggagaaggagaccgtatcctttgacgatttacaggggcttccgcttattgcttccgcacaggcctacagcggccgccagcgccttgagctgtttggggaaatatttgacacgctgaatattgtggcaacctacagccttatttataacgctaccttcatggtcgagcagggaatgggatacgcgctctgtctcgctaatctggtcaatacggaaggaagccgtaatctcaccttccgttctctgtcaccggccttaaaagtggatctctttattgtcacaaaaaagtaccagacgttttctccggctgcgaaactctttttcaatcggctgagagatgaactgggaaagagataagacagacccaaaaaattacaaaaagcaaaacgggggacccttcacaggctggaatccctcgttctgctttttttaatgatactatatttatctcaatctggcttcctctcttttgttcgctgtcgaattacggatatatccggcaattacgacctttaatcccgtaaaaaagtgtccattgaccatctccacgatcccatttaccatttccatgctcaccatgcctcccgtcatttttgcaattccccggaaaggcatattataaataaacaggatgttcaagtccggtttccccttatcctcacttttcttcttccgctttgtcagacagcggtaggccagcctggccagcctgctttttgcatagtacatctggcaaatcgcgtcattaatccccagttccccgctccattttccatccggaaccggatggcccagaagtgtctcgaattccctttctcccacctgctgaatcagtccggaataataggatggcagctgctctctatcatagggcagttccccggtggtaccctttctttcaagccttcctgacagtcggatatctgccacacaggcgcctaccataatcaggtaattcccgccttccgtctcccacttattcgtcctgcagttccagtaacggaaggtcttatcgtcaaatgggatccgcaccttcttcctttccccagccttcagaaatacctttttaaatccttttaattccttatacggccggaaaatggctgcctccggaaggccaatataaagctgtgtcacctctgcgccgccgcaatctccgtcattggccacggtaaaggttacgccgtcttcgtctacctgcaaatccgaataagaaaattccgtgtaggaaagcccgaatccaaacggatactggacccgcaccatgctggtatcatagtaacggtatcccacgtaaatcccttcccggtactccgcatttcgctccgtactggggaagttccggaaagatggagtgtcctcgtatttgatcggatacgtttcgctcaaacggccggagggatttacttcaccggtcaaaatatccaccatggcgctggctccggcctgccccgacagataaccgtgcaggattgcccggcagtttctctcccacggcatctctatggaagcgcccgcactgatgacaccgacaatattttcattgactttcgccagtgtttccagaagatcaatctgattctgtgggattctcatatggctgcggtccagcccctccgcctcgcccagttcattcagtccaagacagtaaatgacaacctccgcattttccgccagatccaccgcttcttttttcaggatatcatccggatctccattccgttcatatccccggctgattccaaccaccgagagctgggaatcaccgattacacgttccatggtctccacctgaatcggattcaccatggaggatcccgccccctgatacctcggctccacggcaaaatctccgatgacggccaccttcgttccagccttcaaaggaaggagtttttcctgattctttagcaggaccgcactctccgccgccgctcttctcgctaataagtgatgcgtttcctggtcaaatgtccggaaagtttttctctctcccttcactgtcagcaccgcctccaataatcggtccacgcaggaatccagatcatcttctgccagccgcccctcaaggactgccgccgcgagttctctcgccgagtccagacccggagacggcatctccaagtcggaaccggccgccactcccgcagtatggctgtttgaaccgccccaatctgtcacgacgagacctccaaatccccactctccccggagaatatcctgtaagagatgcttgttttcattggcataggtaccattcacctggttatagctggtcatgatggacctggctctgctctctttcactgctatttcaaagccggttaaatagatttcccgcagtgtacgctcatcaacaaccgcattcatcgccatccggcgaagctcctggctattcactgcaaaatgcttcggacacgcatggactccccgactttgaatcccccgcacgtaagaggcagccatcttcccagccagatagggatcctctgaaaaatactcaaaattcctgccgcataaggggctcctctttatatttaatcccggaccaaggaggatatttacaccctgagccgccgcttcttcaccgagggcctgtcccaacgcttctcccagcccttcatcccagctgtttgcaatggtggctgccgtcggaaaacaggtggcgggcaaggaagcgttaagtcccagatgatctccggctcctgcctgttttcggatcccgtgaggcccatccgacagtgcgatcgatggtatttccagacgcttaaccgctctggtttcccacgtatttttaccgcttagaaccgccgttttttcttccagcgtcattttttcaatgatagctctatgtttcatagttcacaccatcccacatttgattctgactcttaagcgcaggcaatctttcctgcggtcatttttctggctttactataccacaagttcctctcccgtgcgaagtttggcataaaatgcttaaaatctgcatgaaatgcaaaacaggcggcatcacctgccgcctgaaactcgccgccagcgcatacagtccgccaacgccgtatagattctgggaatatcctgatacagctgcatactcagtttccctccatattcatgtaccggatcaggcattccataaattctttcttcttactgcgcccaatcggtattttctcaccatgaatgatgcagcctccgccggaaatcccatccaccaggttcatattaaccagatatcctttgctgcaccggtaaaatccatactgttccatcagcccttccagatcctttaacgccgcccttgccgtatacgctccggagtccgtcttgtatacagcctgatgcccccgggcttcgatatagtaaatggaggaaacatcaagtttttgaatcccatcctccaccggaatcgtgacatagaaccgcttcctgcggcggattcttcctactgctttctctagcttctgagaaaacgcaaaatactccaccggctttatgatataatccagggcatccacttcatatccctgcaccgcgtattgagtcatattcgtgataaacataataacgaccgcatcatccagtttcctgatattctttgccgccgtcatcccatccatgaaccgcatctgaatatccatcaagataatgtcgtaatcgcctttataattatccagaatatcttccccgtcggaatacacggtaaccgagatctctctctggctttcctgctgataccgctccatatagttttggatctgctgaacataaaatgcctcatcttccacgattgctatatgtatcatcaaatccccctctgctgatttataaaattctgcctgctcgtgtcatattcgtgccatatcaatatcgtatcatcaataattttagcagtcaggtctttaaaatgcaagccataccactctgaaaacaccaaaaagcggaaatcccaatcatcaggatttccgctattctatctgggcatataccctcaaaaccacacattgtacatatcttttcatccgttcttatttcctctgccatttctgacaacctaaaccaacttggttaagccctcgacctattagtgacagtcagctccacatgttgccatgcttccacctctgccctatctacctcgtcgtcttcaaggggtcttactcttgcgatgggatatctcatcttgaggggggcttcacgcttagatgccttcagcgtttatcccttcccgacttggctacccggccatgggtttgatacccaaccggtacaccagaggtcagtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctcgacccgtcagtctcgcagtcaagctcccttatgcctttgcactcttcgaatggtttccaaccattctgagggaacctttgagcgcctccgatacactttcggaggcgaccgccccagtcaaactccccacctgacattgtcccccggccaggtcatggccgcaggttagaaacccaatatcgcaagggtggtatcccaacaatggctccggtaagactggcgtcctaccttctctgcctcccacctatcctgtacatgcgacaccgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcaaagcttcgattgctctaacctctcctcttaaccttccagcaccgggcaggcgtcagcccatatacctcacctttcggttttgcatagacctgtgtttttgctaaacagttgcttgagcctattctctgcggcccactctcgtgggcgctccttatcccgaagttacggagccattttgccgagttccttaacaatgcttctcccgccggccttaggattctctcctcatccacctgtgtcggtttacggtacgggcacgtattacacaatagcggcttttcttgacagcccctataccaacttccctacttttgttcggtacgcgtcacgctttcctgttgttagacggattttccagtctaaccagtccggcgcttgccccggtcttttcattcccgggtttggcttcggttctgtgtccccacagttctgataatacgcggtacaggaatttcaacctgttgtccatcgactacgtctttcgacctcgccttaggccccgacttacccagagcagatcagctttactctggaaaccttagatattcggcctggaggattcccacctccatctcgctactcattccggcattctctcttcttaacactccacgcctccttacggtaacgcttcttcgcagttaagaatgctcctctaccaattgacttacgtcaattcctaagcttcggtgttgtgtttcagccccggacattttcggcgcaggacctctcgactagtgagctattacgcactctttgaatgtgtggctgcttctgagccaacatcctagttgtctttgaaatcccacatccttttccacttaacacacactttgggaccttagctgtaggtctgggctctttcccttttgactacccaacttatctcgtgcagtctgactcccgtacatcatttatgcggcattcggagtttgatatctcttggtaagctttgacgcccccttaagaattcagtgctctacctccgctaaactaatacgaggctagccctaaagctatttcgaggagaaccagctatctccgggttcgattggaatttctcccctacccacacctcatcgccacccttttcaacggatgtgcgttcggtcctccatttccttttacggaaacttcaacctggacatgggtagatcacccggtttcgggtctgcctgaactgactgtttgataccctttagggtatcagcttttcgccctattaagacttggtttcccttcggctccacaccttgagtgcttaaccttgccagtcccggcaactcgccggaccgttctacaaaaagtacgcggttccacctaaaatgtggttccacagcttgtaaacacagggtttcaggttctttttcactcccctcccggggtccttttcacctttccttcacagtactatgcgctatcggtcactaaggagtatttagccttggggggtggtccccccgaattcccacaaggtttctcgtgtctcgtggtactttggaatctgctcgctctcttctggtttcacatacggggctttcaccctctgtggccggtctttccagggccgttctgttaccatacgagtcacttgttgcagtccataaccccggcatgcacgcacgccggtttaggctctttccatttcgctcgccgctactttggaaatcgagttttctttcttttcctccgcctacttagatgtttcagttcagcgggttcccaacgtatggctatgtattcaccatacgccgactgaggtttgctcagccaggtttccccattcagatatctccggatcaaaggatatttgctcctccccgaagcttttcgcagcttatcacgtctttcatcggctcttagtgccaaggcatccaccctgcgctctttatagcttaaccagttcgattttcgcaccatcccctgactgttaaggagggggcttaccctgttaagggtgcgggctactcgtctaagattcatagcgttgaatctctggtcttaggtttgttatcactgtacgttacagtaataacgagtttataattttttcggttatatctgttacgatataacacctcggatgtcttgatttactctttctcaggatcgaaatcccttaaaagaatctatctagatatattcaatatgtggttttcaaggtacatgtagactgaagtttatcagtcattagcaaactcgatcggctcgaatccactaatcactggtaaaaaccagttatatggaacagcactaccctgctgaatcgggttaacacattctttaacacaggtttcgcctttatctccacccattggaacgtgtccgttctatataaaacactctttcgagtgaatttttttaagtaatctggcacccacctgctctcccatgccgtctccagcatagtaccatcggccgctcaagtcttaaccatcgtgttcgggatgggtacgggtgtttcccctgagcgcatcggcaccagaatctctttgtctttgaaacataagactcaacagtatataaaacccttacttcttcttccttagaaaggaggtgatccagccgcaccttccgatacggctaccttgttacgacttcaccccagttatcagtcccgccttcggcagctccctccttacggttgggtcactgacttcgggcgttaccaactcccatggtgtgacgggcggtgtgtacaagacccgggaacgtattcaccgcgacattctgattcgcgattactagcgattccagcttcatgcaggcgagttgcagcctgcaatccgaactgagacgttatttttggggtttgctccagatcgctcctttgcttccctttgtttacgccattgtagcacgtgtgtagcccaaatcataaggggcatgatgatttgacgtcatccccaccttcctccaggttatccctggcagtctccccagagtgcccaccatcatgtgctggctactaaggataagggttgcgctcgttgcgggacttaacccaacatctcacgacacgagctgacgacaaccatgcaccacctgtctccattgctccgaagagggacaccggttaaggtgttttcaatgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgttagcggcggcaccgaaggacgttgtcccccgacacctagtattcatcgtttacggcgtggactaccagggtatctaatcctgtttgctccccacgctttcgagcctcaacgtcagttacagtccagtaagccgccttcgccactggtgttcctcctaatatctacgcatttcaccgctacactaggaattccacttacctctcctgcactcaagtcaaacagtttccaaagcagtaccggggttgagccccgggctttcacttcagacttgcttaaccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctggatcaggctttcgcccattgtccaatattccccactgctgcctcccgtaggagtttgggccgtgtctcagtcccaatgtggccggtcaccctctcaggtcggctactgatcgtcggcttggtgggccgttaccccaccaactacctaatcagacgcgggtccatcttacaccaccggagtttttcacaccggaccatgcggccctgtgcgcttatgcggtattagcagtcatttctaactgttatcccccagtgtaaggcaggttacccacgcgttactcacccgtccgccgctaagtcgatttcaaatccatccgaaaacttcatcgaaaccgcttcgctcgacttgcatgtgttaagcacgccgccagcgttcatcctgagccaggatcgaactctcatgttaaatgattcgtttgatccggggtcaaaatcaactaactagctaatttatttcccgttttacttgttgtttggttcgtatacaataattgtattcgttctgaattttctcattcaaagccatcaaacaatggcttgttttattagaattttcagggttttacatactgttcaatcttctgttttcaaagtgcgtttgctgtcgatctgtgtcagcagcaacttttatatcttatcacagtgatttatttttgtcaaccactttttcattttcttcaaaactttctcagcggttcagctggaagatttctggaaaagtttgccgccgttttcagcggcgaggtatattatatcaaagcagccgacaaaagtcaacatgttttttgttttttttcatttttttaaatttttgcgtttttttattcatattcaactatgctgttcccataaataaaagcggttccgggaaaacccgaaaccgcagatttttactatcaatcaggataactgaagcagctccttgcaataccaaatgattacaaatcaaaatatctctggaactccgccggatgtggaatctgagacagttcccggctctccgctcttttcttcttaagccatatctcaatcaggcgctccgggaacacgcctcccgctgtcagatattcatgatcggcctccagagcatgaagtgcctcatccaatgtctttggcagcgactggatctttgctttttcttcctccggaagatcatagagattacagtcaaatggcccccagccatgtttttccggatcgatctgattctgaatgccgtcgagtcccgccatcaggatcgccgcatacgcatagtaaggatttgctgttgcatccggatttctcagttcaaaccgtttggccttcggagtcttggcataagccggaatcctgatcacggcgcttcggttggatgtggcatatccgatggtcaccggtgcttcgtatcccggcacaagacgcttaaaggagtttgtagacggattggtaaatgcacatagggatgggacgtgttttaacagtcctcctataaagtagtgtgcagtcttactgagaccggaatatccatcctcatcgtaaaaaaccggctccccgtctttcatcagcagcatatggacatgcattccattgccggcctctttgtaaatgggtttcggcataaaggtagcagtccttccatcctgaaccgcggcgttatggatcacgtatttgataatcatggtcttgtccgccatgtccaccatatcgcccagctccacctcgatctccatctgtcctgagccgcctacctcatggtgatggtatttcacatccactccccactcctgaagcatcatacacattctgcttcttaaagtataggctgtatcctgaggtgccgcgatatggtatccgccgcctccgggtactaaaaagcctttgttatcagcagactccctgccgctgttccaggccgcctgcctggtatccacggtaaaagccatacgctgcggctccaccatatagctgacattgtcaaataaatggaactcgaattccggcccgatcagcatctgatccgcaattccctgttccttcatatattgaatggcccgcaggcttacattcctgggatactggtcaaatggcttgttttcctttcctatgacacatacgtctccgcacatggtcagcgtcggaatctctgtaaacggatccaccacagcagtttcggggtccggtataaataccatatcactcttttccaccggggcgtatccatagttcgaaccatcaaaaccaatcccctgcgtaaaaatctcttcatcaaaccgttcaaccggaatggtaatgtgtctccaacggccgtttaaatccgtcatcttgaaatcaatcatcctgattcccttttcttcgcagatgcgcagaacctctgtactctttgacatagtttcccctccaaatcagattgtcagcaaaatttgcctgttatgttgattctaccatattacggagaaattatcgcccctttaaacggcttttcctgcaatatttttcgcttgcggcggttctgtcagaatccggtatattcgtccatctgcttatcccatctatacatctctttcaaacgcctgatctcctccgcatgtcccgtcaaatccgtaggcgtctccagtataaacggcagctcatggagcaggggatggttgatgatcctatggattgtctcttcccctatatacccgctgccaatgagcgtatgccggtccttatggctttctctgacattcatgctgtcattgatatgaaatgctttcaggtattgcaaaccgatcagatgatcgaaatgctcaagcacctcatccagatgattcacaatatcatacccggaatcccacatatggcaggcatccatacaaaaacctatcttgtccttcaattccaccctgtccaatatgcttttcagctcctcaaagcatctgccgacttcacttccctttcctgccatcgtttccagcaataccattgtccgcatttccgggaacatggtctgattgagtccttctgcgatctgttccactgcacggtctacggactgatccagcctgctgcccggatggagattatatagatttcccggcatgaattccatgcgcttcaagtcttcgcccatcatttgcgcagacagctctcttaaatgctgatttgcggagcagagatttaacgtataaggcgcgtgggcgatgaaaggcgtgaaattgtggtttcttaatatcgtttgaaacgcctctatttcctcaggcttaatctcttttgccctggctccccgcgggttgcgtataaaaagctggaatgtgttcgcaccgatttttacggcatcccttgccagcgcagcataccctttcgcaacagacagatgcgttcctatttttaatgttgaattagtttccggtctttctccggttatccgatttttattcatatatatagtatccgtgctttgccgtgaaactatgtatgaagcgcgaaaccgaaaaaggatcgggcagtgattcacccgatccagacttttattttgttttctaatcatcgattaaatgcttgaatttctccatcggcaaatcaagcgcgtaaatccaatgaaacagcacattggcagccaatacggagcctttgtccgagaattacattagttatttaccacattctgtggttttccggctaaaaatgccttcacattgtccacggctatatccatcagtctctgcctgctttcctttgatgcccaggaaatatgcggagtaatgatacaattgggggcgtttaacagcggattatcgcctcggatcggctcggtggatactacatccaggcccgcggcgtatacctttccgcttgtaagggcatccgctaaatccttctccacaatcagtggtcctcgggaattgttcagaataatgacgccgtctttcattttagcaatactatccctgttaatgatgccttctgtctccggaaacagcggacaatggagcgcaatcacatcggagccagagagaagttcatccaaatcggcataatggcacgccgcgctttccagctccgcatttttgtacgcgtcacaggccagcacattcatgccgagtgcctgggcgattctgcctgtgctctggccaattcttccatatccgataattcccatggtcttaccggctaactccatcagcggataatcccaaaaacaccagtcctgattctgttcccatcttccatcgtgtaccgcctgatcgtgatggccgatatgatggcagatctccaggagcagggcaatggcaaactggcctactgcatccgtgccataggaggggatattgcatagaggaatccccttttcttttgccgctttgtaatccactacattatatccggtcgccagcataccgatgtattttatattggtacaggagtccatggtttccctggtaatcggcgttttattcgttatgacaatctccgcgtctccgatccgttgaatgatctccccggtattctcaaacggagttctgtcgtatacggtcagttctcccagcttctcaagttctccccagctcaaatcacctgggttttcggtatatccatctaaaataactatcttcattctgttcccctcgtcattcttcttacaataatttcatcgctttggatactatattatcgactgatattccatttttgtccaacagcttttcgtatggcgcagattctccgaaatggtcctggattccgatgcgaatcacctttccggttccggcctcggccgccacctcacagaccgcgcttccaagcccattgatcacattgtggtcttctacagtaatcactcttccggttttcttcagagcatcgagtaccgattccgtgtccagcggcttaatcgtatgcatatccagaagcctcacggagattcccttctcttccaggaggtctgcggcctcatatgcgcggctcatgacatcgccgttggcaatgatcgtgatgtcactgccatcttttaaaacctttgctttcccaatctcaaatgcttccgtctcatcatagacaaatgggacggcgtccctcgtgaaccgcagatatacgggcccctgataatatgccgcggcgcgaaccagttttctggtggaataataatcacatccattcacaatcgtcatgttgggaatggttcttaaaatccccatatcttctattccctggtgacttgcgccgtcattggccggtgtgagacctccatgggagcaggctatcttcacgttcaattttggataacagatctcctgacggatctgttcactcatgcgcatgctgccaaataccgcatacgttgtgacaaacggaatttttccgcaggccgccagaccggccgccacaccgcaggcattctgctctgcaatccccacattcacatgctgtctcggaaactgcttcgaaaattcaaccgttttgcaggattttccgatatcacaatccacgatatagaaatcaggattttctttccccaattccagaatctcatcaccatacgcttctcttgtgggacgtcctacgtttcttacgaacattaaaatccctcctctatatcagcaattgcccgtgcatactcttcatcattcggcgccattccatgccatgacggaatattttccataaaggacacgccttttccctttactgtctttgccacgatgcagtgcggcttacggctgccgctggctctgacagcatccagcgtatctaggatttcatccatattatggccatccatattatacgtattgcagccaaaggccttaaacttttcagccagatccctggtcggcatgactgcgtcgcagggtccgtcattctgcagtccattgttgtctacaataataatcaggttatccagttcgtatttggatgcggtttctgccgcctcccatacctggccttcctgggcctcaccgtctcccaccagcacaaacacacggtagcttaagccatctctctttgctctcaaagccatgcctgcggctgtggatattccctgtcccagcgaccctgttgaaatatcgattccggggcagcgcttcatatccggatgcccctgcagaatggatccctccctgcgaagcgttcctaaaatctctttgtcaaaatatcctctgagcgccaggcaggtatacaaaaccgggcaaacatggcctttggataatacgaaccggtccctgccatcccatttcggctcctccggacggatatttagttcatgaaaatacagcgctgtcataatgtctgccgctgacagcgaaccgcccggatgtccggagcctgctgtatgtatcattgtcagcacttcttttctcactgtctttgcctgctgtttcaggctgtctaccatcgcttgatctcccatggcacgatcctttctattcgttcatcatacggtaaattttctcaaatccggagaggccgatcttatagacaggcacatttaccggatcatgcggaagcaggctcatcgatatctgtgcaaatgcaatgacatcgactttttcagctaattgatacagagcctcgcacaccatgcggtcatgcttttccctgtctccgctgcagagcacatcaaaggctccgtctaccacttcatttaccagttcaatttcttttccggcttctgcagccttttccataatcacacgtccgatggccgcagggctggtaggaagcgtagccaggattccgattctcgttccgttcgctactgccatctccgccacgggttcttctatattcatcaccgggatgtttaagaatttcctgatatactttgtcgcttcattgacagacgtgcaggtcgtcaggattccatccgctcccgacgcctgggctgcctgggcatagcttaacatccggctgcacacattggctgtgactccgccgcccgccagcgtttcctttaacagactgtcatccatgatgttatagatcgtaagaccctctgtctgtgccgcaaacggttcgccgaagggcttaaagatgatgtccataaagttgttgaccgtgttgatggtatacaatgtttttttcatttttctttcctctgttcctgtttgaattatgataaatggttattgtttcattcctgaaaaagcaatactttgaacaatgtatttctggcaaaagatatagataaccgacagcggaatgatgctgatcaccgataaggccagcgcagttcccgcatgggtggctcccgcagatcccgagttataaatctggagcccgatttgaaccgtataattgctctgcttcgtcatgacaatcatcggccagagcagatcattccacacattaatggaatccagcaccacaatcgtagcgataattggcgtaagaagcggcagataaacctggctgtatatcctcatcaaattcgcaccatccacgcggcaggcttcatataagtcgtccggcaggctgtcacaatacgtcttgacaaagaatatgtacatggcattcgtcatcacgctcggcagaataacgcccagaaaggtattatttaagccgatgcccctgataatggaatagatcggaagcagcttggattcaaacggaaccatcatattggaaaggatgataagcagcgcaatccctttccccggaaagcggcccttcgatatcgcaaaaccggccacggtggacgtcagcacattaaaaacaacgcttaataccacgagaatgattgtatttttcaaatagctgagcaccggtacattggtgagagccatgttatagttaaatgtgctgaatactttcggaagcattcttggaggaaatctcagtgagtacgatttcacataatcaaagctggtggagataaaccagaagaacggaactacgataatgagtgccagcagcgacagaatcacatagcttactataattgacggttttaccttctttttatgactgttcatgctttcgtcccccttcttttcggtttgtctgcactgacttctttttcctttgtcaggtggctgtttaccagtgtggccgccagaataatcaggaacagcaccacagatgccgcgcctgccagcccctcatccttatagttcagcgttgagaaagaattcttataaatatacagcaataatgtctccagtctgcctgccggattgccggtctccatgctcactgcataaacctcggtaaaacgcttcaaggcggcaattgtcgatgtgatcaatacgaaggtaaacgtactcttggaagccggtatcgttatatagagccacttcttaaagctgttcgcgccgtcaatctccgccgcctcatacatatcagcgggaattccctgaaggcctgcaaagaaaagaataacattatatccaattcccttccacacagcgataaagacaacagactctctcgccgtccccgttccattcagccacaggctcggttcgaaacccaatactccaatgatataattaaaaacaccctcttcgttcggcagcatcagatatttaaacagcgtcacaacggttaccatagacattaccatcggcaaaagaaagatcacgcggtagattcctttgcccctgccgatattatttaacaggctggcgatgatgaatgcgagcggtatattaaatgcaacacccaaaacagccatatagagtgtattgataacggtctgcttaaactcactgctggcaaacataatacgataattggtaaagccgataaatttaccattcatattctgcaggctggtaaccatcgtctgaatcagcggatagaaattaaataccagtgttcctaccattggaatcagtaataacagataccagctgatatatcttttgatctttacattcttcataagctatcccctgactgcctctttatattttcaacccatgtctttacttcattataataggcgtccaccgcctgatccgcggtatactgcttggacaaaagctggttgtcaatggtctgcatcgcagtcctccaataccagtaatcgtctgtcgtaaacatatttttctgctggtaatcaagtctcttctggttgatttcataatccatcatggtcattccggaagaatcctttaagcaggtgatcttatctctggcgtagttggtcagatagaaatcaataatctccttattcgttaccatatctttgattacttcccatgcagcatccggattctttgcattttttgcgattgccagccggaagaattccgggaagctggcgccgtaggtgccctctggaatcataaccgccttatatctgtctgtcgtagagctgtcccctgcgtaaacatactgcatgtacgcctttgtctggttattgcagtcaaagttgatcgccgtatcattatcctctgtcagccagttatccgcaccgtctcccgttgcaaccgcctcattgcagcagtccaccagtctgatgaagtcagtaaaccaggcctttgcttccggcgatgtcttaatactctccacatattcatccatatccagctcgctgatattcatcgtatcactggtaaatggctttgctacatcgtagcttaacgcataccactctgcccactcatgaaatataaatgctccatagtttttctttccggtaaccgggtttgttccggtcattttctccgccagatcaaccagctgggaaaaggtcatctcttcattgggttcttccactccccactctttaaacagctggctgtcatatgtaatcatgttgcacgcaatcgtaagcggaagtccgtatatattaccgctctcttccggatggttaaaggatttatatctggtgtaatagacggcagggtcaataaacagatccgaaagattgtttaaattaatctcctcatccttttcaagatacggtgtcagatccatataccagctgggtaccgcttcctgatttgtaaaaatgcccatatccgcttcccccgcggtcagcatggcttccatactctggatccagccatcccaggcaatcgtcagaatctcgatgttataatcaggtatctttgcattcagaaaatcctgaaattcccccagacttttcgtctccagaccagataccggatcgacagtcgaattctcgcttaaccccggaatgatcattctgaccgtctccttgccgctcttatccgcagtcaccgttgtctctgccgattttcccccctgtcctgcattgtcccccgaaccggagcaggccgtcagtgtcagggccatagccgctgctgtcaataatgctgccattctctttgctcttttaaacatattcttctcctcctatatatgaaattctattatttttgaaaggtattttcgtagaacgtcctacgtttaatgatataaaacaaacgtttcgcttgttttatcccggatttaaacccgttccctccaggtagccagtgattccgcaaccacctcatgaaccgtgttgtaatctttattgacaatacagtccagaattctctggtggtataacggtgcctttgaatcgacggtttcctttctgacattctccacgatggatttttcaaaaatgctgtaaacgctttttaaaatccgaataaagaaaatgttcttgcagctgtcaatcaaaagcatatgaaactctaagtcacacgtctgcatctgttctacatcctggttcttacaggcatccttcatcttatcaatactgtgctgcagcttctctacctcttccggcgtgatcttcgacatcgccagctgtacggtcgattcgtccagaatctgccggagttccagaagctcgtcgctgctgctcacgtcataaatcatgctgtaaacaagacggtcaaacaatgtgggatttacctgggaacagatataagttccgtcacccctcttaatttcaacaatccccattgtcgccagaatcttcatcgcttcccgcagagaatttctgcttacctgcagctcctccatcagttcgaattcactgggaagcttggaacccgatttgtagtctcctcttataatggattccgtgagggtattgataatctgatccacgatagtcttctgtccgattgtctctaatctttttctgtcattccctgccatgcccttctacgacctttcaccatcatttgttactaatatatcataaattactctgcaatggttcttttttctattatttttccgtcgcggagatggaccactgccttccactcttcaccgctctcaattcccgttaccggtccctgccaccagttctctataaagttgataacaaacggatcgtcatatgcctgctcatacagaataccgtctcgatagaattccacataatcgatctgctccggatataaactggccagacggataaaacgctttccttcgtacgccatgtccttttctaatccctgaagataaaactggtcttcaaatggaagatcactctgctttccagtcagatactcctgcatccgcagggcaaagtatgcgtcctctccctttgtgattccccatactgtcggcggttcctgcttcgtcatgttattgtaatatccccacgacacaccgttctggaaagtgaccttcatctggctcagcgcctgcgaatcttcgttcaccactatcggcctcgccggctgaatcgcctttgctttcttaatcagattgtacagcagattccttgactgtgcatttccatggatcagaattacgtcggatgctttggctatccgctctgaaaagtatccgcctgtgccggaacagccgactggaagtccgccggatacttttttcgcaatctccatcagcctcagaattccattctcctgactcaaaaccttatggcattcaaaagcgctgatattgtgctcattggcagcctcgatgataacattcttatcgtcccgatctttcagccaccggcatatatttgtcaccgcctgctccaccgcgtcatcatcggtaagatacatactctgtactccataaaacaggcttacaatcacaaccattccctgccggtcagccgcgtcgatgagtcttgccagcctgcttaaatacgcctgatccagatttttcccatcgcttccatacggattattatcaatcgaatccagcggaatcgtgaagcagggaccgccgccctgcagcccaacggtgaatgccctcaaacctgcctgataccattcaggaagactctcgatcagttcgtctgtgttctgatccggatcaaagctttttccgaaacggctgtatcgttccctcccggtcttatcatcgtaaatcccctgaatgaatctggcattcatgagcagcccgcgataaggacagccatcgatctcactgtacgtcagttccccattaatataaaacttatcgccttttatggtcatttttgtatgattcatataagcctcctctgttatatgtagaacgtcctatgtttgtattatatttgtgtattgcatatttgtcaatatctttcttgatttatcttatttattggttattatatacattttggggattgtatttttatttatatttgctgaaggaattgttttcaccataatataacgcccagtcctgttcattcgcccatggatcgtaaaagtttgcttgacagtctccatttacaggcatataattatactgaccagtcagtacaactttggagggatcacaatggcaagggcaagcaaaaaaggcttaattatgaagactgcgaaacaactatttgcggaaaaagggtacgacgccacaggcatggaggaaatcgcttccaatgccggggtacccaagtctctcatctactaccactttaaaagcaaggaagatctgttaaatgctgtcattacagaatttgttgacgaatacaaggagatcctgcatgacagccgggctaaggggattgaaaagatatccgtgtacatggaatttctcaaacagaatcgggactgcgccagaattctcatgagcgagtctttaaaaagcggaagcagccagacgatgctgtatcaggtgctggctccgttgatggagatcgacggggaacaatcatcagacaatccgaaaatggaccatgcccattggctgactgaattcttcacaagtattcttcccagtatactgattgtctgttatgaggacagttggtgcgattactttggcatatcggccggtcaaatggaagaggactattttaccgcttacaggctgacgcatggggcttatcatgagcatatccacaaagtgagtaaatgagaaatgatataggacgggaaacagataaaatcaattacaaaataaaatccagcgataaacagggaggacacacgaatgaatcaggaacaagcccaagtatcacaagacagatccagatctatgcataacatctttacaggtgcattcagcctgcttcttttcatcgggatagcggtatgcgctatctgtgataccgcgatttcacgatcgtttacatggtcactgtatccgatcagtgcgattgtctttacatggctggtcttcatccccatgatcaaattcggtaaaaaaggagtttgcggctccctgctcatgtgcagtatttttattgtaccgtttttgtatgtgcttcatagactgatccgggtcagcgatttattttttcctgtcagcatcaatatggctttcattggagttgtgtatctgtggtgtattttcttcctgttccgggtattccggacacggaaattactggcgtcaggaatagctctgctgttggtaattcctgtcgatctgttcgttgcatttacgctttccagattcatcgccgagccgttcaatgcatggcatataaccggttattttacaattgcagtaatagccatggtacttattatatctcaaggttattcgcgtaattaattctgcaaaaaaatggctgaagtcttatgacctcagccatttttctgtttggagagttttttcaacccccttttcatctatgcttttacaccagcactccggaccttgcactccatgaccgctattccatgatcagcaataacgccgaccaccaaccgcacttctatttactgataaatattattgatcttccatacaccattaaaacgatacatcgataatccggaatccccgcccatctgcacgccggcgtcaccgacattggtcagcttatccacgtccgtccggtctatggcatctctcagcttttccgtgaacagcttatcttcgcccattgcgactaattcctgcggatttcttatttcttttaaattaccattttcctggacgatcgtcaaaggatagttgcacagctttgccatggtgtccatatccttgtatgaaaatgtcttctggatcgtgactgctgcctcctttatgtcttttatcgccagtccatcaccagccgcggtatccagataaatactgtttactttccatttcttcttgaatttgtacaggttcaggccattgtctccgcccatctgcacgcctgcattcccctcagcctgaagcttcgctgcgttggtggaggcaattgcatcctgcattttactgctgaaaatgagtccggagtccagtttcttaaacgccgctttatctttgatctccaccagggaaccgtctccgtagacgatggtcaatggaaaattacataatccggccagcttctccatatccttgttttgaaatgcaatctgcaccgcctgggccgtatcctgaaggccggactgggactgcctcgttcttgacttcgcagccatcaccacatttcccgtagccgcaaaggccgggacagacggcactgctcctgcaatcgccaccgcacacatacaaatcactgcaaatcttctcataatgaatacctcgtctttctattttcttattacaaacgattagacgtctggtatcggtgaaaaagtttcagcaattttcattttatggatagaaatggtaaaatcagatagatcggctcatttctcctgtccctccagtatttcctccagcgttcgccatcccagcaccgcgcacttcacccgggcgggcatatgggcaatgtcctgcagggcggccgcttcctccagtgcctctaaatccgcctcccctgccgtgccccgaatcatctgaaagaagttttcagccagcttcacggcctcttcctttttctttccgatcaccaggtccagcatcatatccgcggaagcctgggaaatcgcgcatccgtcgcccacgaaggatccatcctggattactccgtcctccaccttcagctttagccagatatcatctccgcagctggggtttacgccctccagcaccagattggcatccggcagatcgtgcttgtgagccggacgcagattgtgttctgtcaaaatctcattataaaaacttctattctccatatcccatcttcctcctgattccggctgtgctctttaaaaatgcctcaatctcctcacgggtattataaaaatatatgctggctctggcagcagaattgacctttaaatattcaaacaacggctgggcacagtgatgcccggcgcggacggcgatgccatctgcatccagaatcgcgctcacatcgtgagggtgaacgccatctatggtaaaggtcaggattccacagtgttcttccggccgctcagatcccaggacatggacgtgcggtatctgcttaagtccctccagggccatcgttgtcaatgccagttcccggcgatgcacctcatcaaatccaacacgtttcagatagcggatcgcttccataagcccccaggctcccgccgcgttgacggtgcccgcctcaaacttatgaggcaccggggcgaatacggcccctgttctggtgacagagtcgatcatctcccctccggtgaggaagggcggcatctcctccagcagttcccgtctcccgtacagcacaccgatgcccatgggccccatgagcttatggcctgagaaagccagaaaatccacgcctgattcctgtacatcgatcggcatatggggcgcactctgtgctgcatccacgaccacaacagcccctcgctccctggccatggccgcgatctggcgtatggggttctcgcatcccagcacattggacacatgggccacagcgaccatcctggtacggtcagtaaatgccgcctccagacgttcctgcgtaatccggccgtccgcctcgcactccagaaatcgtaaaaccgctcccgtcttttcagcagccatctgccagggcagcaagttactgtggtgctccatgatacttaccaaaacctcatccccggccttcagccgggacagtccgtagctgtaggccaccaggttcaggctctccgtggtgtttctggtaaaaatgatctcgtcggaggacgatgcgttaataaagcgccgcacttcgtctctggcttcctccagacgttttgtggcctccatgctcagggcgtagaagccgcgcatgggatttgcatagctgtgctcataaaaatcccgctccgcctggagtacacaggagggcttctgagccgtggccgcactgtctaagtaaatcaccggattctccttaagcaatggaaaattttcgcggtatggatttctatcttccatttttccccacctcctccagataatcctgcaccatctgctccgcggcttcgtcgccaatcttccgacagacggcatccagccgggcccttgttatcatttcagcggcagcctcagggctcatgcctctggagcagagatagaacagcagttcgtcatccagtcttccgatggtggctccatggtttccctggacatcctcctctgcacagagaatcagaggaatggtctgattgatcacgtcgtctcccagaagcagcacatcctccttctcctctccctctgccccggcggctccaaacttaaaatcaatggttccgcgaaagagcttaaacgcctggtccctcagcacacctccggccagaatccggctccgggatttctctccccggtggttcgccacgtagttcatgtcaaaccgctggctgtcccttcccaagtaacccacatcggcgttcatcgtactctctttccctgcaaggtccgcctggcagcccgcgtaagtctccgcaccgcccaaaaacagctggattacctccacggacgatccctcgccgcagcttccgccgatatcgcttaaaaatgtatagccgcttcccagaagctggagctggatcagcctcagtctggcgtttttcctgacctggaaccgggtctggacagcggtcagccctgcggcctccggcgcagaggtgaaatccataaccacgtttagagtttcgtcctcctgtaccagaagctccacggtctggaagctctttgctccgctgccgcagacgaaatgcagcgcggcccgccgctcttcttccgatggcccggactggatccggatcgcgtccgcattcgactctcgcgccagtcggtccatatcttctcccatcccggtggcaatggccgagaaatcttctctccacgtaaccgcttccgcaaatccttccgtgattatcgtgggggattcccctgcctctatctcatttaagcctgcctcattcattttcagccagttccaggtcctggccggcagcctgtttatcttcaaatcaagtccctgtcccataggagacctcctttcctaaactaaccaatactgcccttcatctccagccggatcagattattcatctccacggcatactctaatggcagctctttggatacattatccgcaaatccgctgacgatcattgccctggcatcctcctcgctcagtcctctggacatgaggtaaaagacggcctcgtcgctgatccgcccgatcttggcctcatggccaatgtccgcgtccggggttcggatatccatagcaggaattgtgtccgaccttgatatccggtccagcatcagagactggcaggagacagccgatttgctgttcttcgcccccctggccaccaccacggagctgcggaaggtgcttacgcccccgctcttggatatggatctggtgttcatataggaggttgtctccggagcggcgtgaaccactttcgcgcctgtgtccagattctgcccctcacccgcaaaggtgattccggtgaactccattctggccccgcggcccttcaggatgctcatgggatataagtaggaaacatgggagccaaaggaaccggacacccattcgatggtgcctccttcctccacctgggccctcttggtattcaggttatacatgtttttagaccagttttcaatcgtggaataacgaagcttcgcattccttcccacaaacagttctacacagcctgcgtgaagattggccacattatatttaggtgcggagcagccctcgataaagtgaaggtccgccccttcatccacgatgatcagtgtatgttcaaactgccccgctcccggcgcgttcagccggaaataggattgcagcggtatttccacggaaactcccggaggcacatagacaaaggaaccacctgaccagacggccccgtggagcgctgcaaacttgtgatccgaaggcttcaccagcttcatgaaatgctttttcaccatgtccgcgtattcccccttcatggcgctttccaggtccgtataaaccacgcccatctccgccacctcctggcggacattgtgatagaccagctccgagtcatactgggcgcctacgccagccagggatttcctctccgcctgggggattcccagacgctcgaaggtatccttgatctcctcaggcacatcggaccacttcgtcttcatctttgtgttggggcgcacatacgtggcgatgtggctcatatccaggccctccagggagggaccccaatcgggaacgctcatattattgtatatctgcagggactttaggcggaacagctccatccaaagcgggtccttcttctcttttgagatttgctccacgatctccggctttaagccttcttctatacggtaaacatccgtttcttcatttcggatgtcgtaaatacttctgtcgatatcatttacatatgttttttcttccatctctctcttccatcctttccggatgcgcggactggagtgtatctgaaaattacttttcgtcaaacgctctctaacagcccgcctgatccaaatattgttcaaacccatgtttgttaatctgttccaccagagaaccgtctcctgtcttcacgattctgccgtctaccataatgtgggttttgtccacacgcagggactccagaatccgggtgctgtgggtgataatcagaagacctccgtcccggcccttctggtactcctccacgccctgggacacggttcggaccgcatccacgtccagaccggaatccgtctcatccaatatggccagactgggctttaagagcagaagctgaagaatctccgctttctttttctcaccgccggaaaaccctgcgtttaaatcgcggtctccataggcccggtccatctgcagcagttccatggccttctccagctccttgcggaaatcccacagccgcactctggcgcccctgcgctgttccacagcgctgcggataaatgtgcccagcggaaggcccggaacctccagcggattctggaaggaaagaaacaatcctgccttagcccgcttatcagccggctcttcgtttatccgctttccctgaaaccagatatctcctttcgtcacttcatagcgcggattccccatcagcgcataacccagagtggacttacccgctccgttcggccccatcagcacgtgagtctccccctttttaatctccagattaattccatgcaaaatctctttatcttccacattgactgataatccatttacttccagcaatcgttttgacatatagtcctccattccgcctgaaaaaggcttttctctcaataacctacttattcacttggttatactcatcataatatcataaacctactttgtcaataggtttatgactatatttgctattgataatcctatttaccttgttgtataataggattatataaccagtgccgcccggtactggtattgcggaagggaggggtgtcaaatgatgatttcaacgaggggacgttacgcgctgcgggttatgctggatttggcacagcagaacaccgacaggtacgttcctctgaaagaaattgcgaaccgtcaggacatctccgagaaatatctggagattatcataaaggtcctcgttcagaatcagcttctggccggcctgcgcggaaaaggcggcggttaccgcctgacgaaggagcccggcgaatacactctgggcgagattctgcgtctgacagagggaagtctggcaccggttgcctgcgtggaagaatcctatgcggaatgctcccggcttgaatgctgcctgacgcggcctgtatggcagaaactggatacgatcattaatgagtatctggatgggattacgctggaggatttaatcaaatcgcctcagaaactggtgtgaaagggatgaatggctgtaatcagtgcaattaaggaatagacggaattatttgtacatggtagaatgcaggctgttggatacgcaggcagatatgccaattcatcgttccggaggtgcattatggagaaaaacatcatcaactattacaaccattacgaggaagacggaaggctgtttcgcaattacagtcaccaggttgaatggctgactaccatgtactattttgatcgcgtccttccccctcacagcaggatatttgatggctgcgcaggaaccgggaattacgccttcgaactggccagacggggaaatgccgtcattgcgagtgatattgtaccgcgcaatgtggatatcatgcggcaaaagcaaatgcagaagccattgctggacgacattttcgtcggagacatttgtgaaatgaatccatatgaagatcattcttttgatgtcgtactctgcatgggggcattttaccatctggatgaaaaggcccggaacatggctctggagcaatgtctgcggttattgaaaaagaacggggttttagttatttcctatattaatttcatggcagcattacaattaaaccttaatgcgaaactagagaatatgggggatgtgttaaaattctatagcaacagaggtgaggatgatccttttacctatttgctgccggaagagattgaaaagactgcacatgaccatcagctcaaaattcttcatcacctgacatcagacggcacggcttatatgagaggggaacagctaaataatttaacaaaggagagctttgatcagtacatgaagctgcatttggagacttgcgaatataagtatatcctggggtatgggctgcatgggcttattattttgacagcatgatgttccagttattccatgttaaatttataatttatcgttgaccgcatcccttaaataaaaattgagggatgcggccaacggtcttatactgcggcgacatcattttttctgcacactctataagttttcagagtttaacacaccgcctctttagccttaatccaagataatcaatgccataaagatcagatcgtcatctcctgtattcaccaatccatgtcctctgcccgatggagtaaacgtcacatcaccggcggttaccggacgtattgcgccattatcgttataatctccttttcccgacagaatatagtatgtttcgctttctccgtgatgttcatggtaaccgagagaacatcctttcccgattgtgacctctgcatataaaccgcatttcccgtttaactcctcttttcctaaaatgtgcttaatcacgacacagccctctccgccgcacatattctcgattttttctattgtcatcttccgttcctcgctttcatcatttttattccagaagcctgccgcacttccggtccgcctgattctgctgaccagacagcttttttactgcaatgtataagccgcttcaaatccacttcttacggctccttcaattcttccaacctgtttcgcatctcctgcgacgattaccttatcacagatttctttacacgcctgttccaggggattgacagatcttgcgcccatggcaagaactacgtaatcggaaggatactcttcgaaagtgccgtcctccaaatgttccagaacggccgcatccttcttaatctctgccagtctggtctttggtttgtatgtaatatcatacttagaaagtttgtccattgcatccagatagtgctggacatagacgccctgtccaatggaatccagcatctccacaatagtcacctcattacccctggcacacagaaattccgcggtttccagtccggtggctccggagccgatcacggttactttccggccttccagcaccttttcgtcgcaaagcacctctttgaaggtgaccgcttcctccagatcagagccggggatggaggacggcttgatgggtgtgcctcctgtagccagtacaatagcgtaaggagcataggaggcaatccggccggcatccgcctccgtatttatgagaatctgtacgtcatatttcttaagctgcgacagctcatattccacgatccagtccatcttctctttatgaggcgggcggtccgcaatgttgatctggccgcctgcacggccttccttttccaatacaacaacgtgaaagcctctctcccagcacgcgcgccgcttccaggccgccgactccggctcccacaaccacaaccgttcttcccgcgccgtctttctcatgagccggatatttacactctctgcccgctctggggttcaccgcacatttgacaggccccttcccggcaattgtatcactgacgagagtctcaaaacaaaacgtacaggaaatacagcggtttatctcatcttcgcgctcttgcgctgcctttaatggccattctggatctgccacaacagcacggccaagtccaacaaaatcgaccatctcctcttccagcatcttctccgcaaaccagggttccttcaccatgttcacggcgataaccggaatgcttacagcctttttcacagccaggattctctgcgtccggcagccctgcgggtaggtggttggctccgacagggaattaaaggattcgtagattccattggatacattgataaaatccagacccattttttccagttccctgcagactttgacaccttcctccagggtcagatactcctgtacgccattgggcgccagcaattcatcgacagtcagccggattccaagcgtaaagtctgtgccgcattcccgacggatcccctctattatttctttcacaaactgcagcctgttctcaaaggaaccgccgaaccggtccgttctctggttggtgtagggactcagaaactgggaaatcaaatagccatgggcaccgtgcagctcaatcccatccactcccgcttttttcgctctcaccgcgccagcaacgaatttttgaataacgctttccgcttcctttgttgtcatctcatgagtttcctgctgacagactccgcagggcctgttggaggatgaccagacagggacgtttccgtttaagtttgagaaggtctctctgcctggatgatgaagctgtgcaaaaactttaacgccttcctcatgcagcgctttcaccgctgctgccataggtgcgatctgttcatctctggcaacactggcctgccagggcgccgccacaccgtgctcatcatcaaccctggtattctccaggacgataaggccgactccgcctctcgcccgttccatcagataggccagaaaatcttcaccaatacactgcctgtcgtccgacactcccatcgccagggcacacattacaatccggttcctgatttttacgtttccaatacttccttctgaaaataaccgtgggtacttcatctttgctctcctttcaattttcaaactcagttatgtaataaaaaaagaggccataaaggacgtaaacgtcccccaagcccctttgctgcttcaattatataatggcatttatagattgtcaacaaaataacaaacaaatccggcacccggttgcggcaccggcagcagggaatcaaaccgtaaaatcagtactgtattgcagcggcagcggttttcctgtactccccaggcgtcatgttcaaggtccttttaaacagcgtacagaaaaattttacatcctcataccctacagaccgcgcggcctcctgaatgcacagatcactgccagccagcagctcacagcacttctcaatccggatcttctgcaggtattccagcgcggtcatctccgtctcctgacgaaattttcggctgatatactgctggctgtaatggtattcccggcaaaattgcttcagtacggccctttccctgtaatttttatccagataccggatcgcttccagcaccgccgtactccgcggctgtctctctctgtcatcctttttgctgtcacagacgattttccgtatggtcagaatcaggatctcggtcagccggcaccggaatacctctgtgtatcccacttttttctcctgatattcctcctgaattcccaggatcaaaggcagaatactcccctcctcatcatggaatacccgattcgcggagggctgcccgaagcaccatttatagtaacggatcagggacacccgcagcacttcttcaaaggaccggcagtccgccagtgtatcgtcaatcatctcgggcagaaacaggcagttaatcagagtgaaatccctgcattccctgtagctgtgcctgctgccgtaatcgatgataaaatagtctccggccttcacctccccggatctcacctctccgtccgcatcactgatcgtatgcagcgcgctgcctcctgtaatataggccagttcaaaaaaatcgtggtcatgcatctccacgtcctgctggcagaaaggcatgaccacgatcttgtcctcccgctccgctgtcagtcctttcagttcaattgtattccgttctctcataacaggttaaattcacccccctttttagtatgaaacagttctttttattcatattacaatctggtatcctagaagtcaagacaaacacaagcaggaggaattaattatggattggaaagcaaaatggctcaggccggccagcgatttcggaaatacggctcccgtattttccacagattttgcgttgtcacggactgtaaaacaggcccgtctctttatcaccgcgctgggcgtatatgaagctgcacttaacggccgcaggataggccagtttgtgctggctcccggatggactacctactacaaaaggcttcagtatcaggagtatgatgtgacggatttactcagggcggagaaccgtctgactgtcaccgtcggaaagggctggtatcacagtcccatgcccggattttccgcatcggacttccagaagggcctggccgcccgccccatggggctgctggcacagctggaaatcacctatgaggacggacagcgcagcttcatcgtctctgatgaaagctggtccgtttccgaaagtgcggtccgcttctctgagatctatgacggagagatttacgacgcttcctttatccctccatgctccgggacagccgagacctttgacgggccatatgaaacgctgattgaacagcagggcgaagaaatccgcgagcaggaacggattgcggcggcccgcatctttacgactcccaaaggcgaagttgtggcagacttcgggcaggaaatcaccggttacgtggaaatcagcgtaaatgccaaagccggggaagagatccggctttcccacgcagaggttctggataaggatggctgtttttatacggaaaattaccgcagcgccagggcggaatactgctgtatatgccgtgatggacaacagagctgccatccgcgcctgaccttttttggttttcgctatattcggatcgacgcatttcccggaggtcccggtgcggcgaaaccggaaaatttcacggcggtggtcctccactcccagatgaagcgaacgggacgcttaagctgttccaatcctctcttaaaccgtctctttgacaacatcatctgggggcagaaggggaattttgtcgacgtccctaccgactgcccgcagagggatgaacgcctcggctggaccggagacgcccaggtatttgtgcgcaccgcatgcctgaactatgataccgaaaaattcttcacaaaatggctggctgatctggctgccgaccagggggaggacggctatgtgggccacgtaatcccggatctgctaaagacacagcctgccagcgccgcctggggcgacgcagccgtgatctgtccgtgggcagtatatctggcatatggaaatacagagattctctcccgccagtttgagtctatgagaaaatgggtagattatatcacggcgcataccacgacggaatatctgtggaccggcggtgtccattacggggactggctgggactcgatgcccccgccggcagctataagggttcctccagagaagactttattgcctccgtattttacgcgcattcggcttccctggtgattaaggccggactcgttctgggaaaagacatggcagcgtatgaagcgctccttcaaaacattgtatccgctttccgcagggcctatccgacttacacgacacagacagaatgtgtccttgccgcccattttcatctggccgaagactgccaggcagcggcggatcagcttgcgctgatgataagagaatgcggaacgaagctccagacaggcttcgtcggaacgccctacctcctgcacgtgctaagcgattacggccatacggatctggcttactccctgctgctgcgtgaacagtatccgtcctggctgtatccggtaacaaagggagccaccaccgtctgggaacactgggatggaattatggaaaacggggatttctggagcaggaacatgaattccttcaatcactatgcctacggtgctgtggcggactgggtatactgctgtgcggcgggaattaccccggcagagggatatccgggatacagtaaagtccggatcgcccccgctcccgatgcacgtcttgactggcttgaggcctctctcgacacgaggcatggccggattatctcccggtggaagaagcaggattcactctggcgctatgagatcacaacaccggtggacgccgaagttgtgatagacggaaaaaccttcctcgtgggtgccggaagttatatttatcacagcagcatacagtaagcctggcggatgctttagcggcggcggatttctccgccgccgcttccgtatcaccgctctgtgctgtccgccattgcttccgtatcacaggtctgtactgtccgctactttctctcctgtaagctccatgatggtaaatccgtttttcccattcttcttcgtctgatacagtgcggcatccgcactttgataaagctgatcaaaccggctccccgcctgtgaagatatcgaaatcccgatgctggccgacacctggcagcttgactgctctttcgtacaaaccatctccagcgctttcgataattcagctgctttctcttccagccagctttcactcgagtatggaatgaagacaacaaattcatcgccgccgattctgccgagaatatcatcctttcgaaaatgttcccgtatggctttggtaaaactgcagatgcagtaatccccgaaggcatggccgaactggtcgttcacctgcttgaaattatcgatatcacagataaaaaatgcgtatttctcctccttcttttctatcagctgtttctcgatcagacgctcggtggccgtcttggtaagaaatccggtcatttcgtctgtctgtgccatcagctcttttttcttttcctggtcgatatttttccggtaggaaaacatatgcacactgcggtcttcctcggaataaaacagataggtctccacacgcatccaatggtaatcggatccatccagtgtaaacagaaaatcatagcttaaatgattgttcccggcctcgtattccctgatcgcatttttcggggaaaacatctctatgtaaccttttcggtattcctctttaatctgcttttcagcgatgattcgcaggccctggtcaaacgggacaccgcctgcgccaagattcgaaaaataatcttctgttgtttttcccacataacagtttttggtaagattcagttcgtagatgctttcataaagctgttctgtcgcctccttaaacattgcctgccgttcctccaccagctttgtaatctgcaggttgaatttgcgtataacagacgtgataatgaccaggatggcaatgacaaccagcgcaagaacgaaacacgtcttatagagctgcatatacatctcatgtataatccttccggtatcctgttccacaatcagcatccacgacagttccggtatataccggcttaccacaaagctcttttctttttcctctgtaccggtgtctgtccagagttccaggttttttgtatcctcataccagctaagaacctgatcccgaatgccctcctgaccgtaaatctcaaaccagtcggccgcctcgtacccggtataggaggtggaaatctctatctcgccgttttcattgatcagattggccttgacgttgtaagtatcttcataattctgaagcagttccttaatatagtccatccggattccaacgccgacgatgccgattaccgcgccgtttgtgtcctgtatcctgcagtttacaaatgtcgtgatcttattgtccgcaccgctcacttcgtcattgtccacattcagcgaatactccttattgctgtccagcatatcaaaataccaggtattttccggattatcccgttccattacacggtcaaccccattaaagttataataccttccggaaacagtcgaaaccagaaagactgaatcaaaaccgtatttttcccgataggtctttaagtactcttttgttgtctcctcataggccttgtcatccagatgagacggctctttcattaaatgctcgaccagcaggctgtcgtgagccatcgtcagtgatatattaaccggcttggaaaacagggaggataactgatagtagatcccctccgtggatagtgaagagacctgttcgatgttgttcaaagacacctgatagtttgcccggtagctgaaaacagccgtagtaacaaatccggcaatcaggattatgctgatcagcaggtttgtcctgagaagtttattcttattcgtttgaatggatttcatccgtttatctcctttgcgtcaaacatctcaatagaatgcctgtaagtctgattataggaagcagttcttacacagttcttacaaatcgcatctttgatggcaataaaaaaaattccggcaggactgcttctgccagtctgccggaattcactccatacctgtcattttctatttgtattctgctctaccagattaccaagcgtaaactctgcccagctgtaattggtcatatattcacctgcaaatgcgtttaactgtgtcagatcaccgctgattgccgcataatagtcacagtcgatctcagaaatattgacgccgatcgttcttcggctcttgctgataatattctggattcctgcctccttcagcgccttcatcagcgtaaaaatgacttgatgcacgttgttctgagccgtgccgtcacacggccggtcctcccataagacagaagccagctctgataccgtaattcgggcgcctctccgatcgatcagataggccagacattccttgcttttggccctgggaaagtcaagcggtttttcatccacaaagacctcaaaattgccgaatgtctgtatgcggacccggtgttccgggatatgcggaagagggaaacgcagattgtcaagctcctcccttaaatctttttctctcaccggcttcattaaatacccgcttacatgaagctgaaatgcagtctgcatatactgggaatagcccgtgacaaagataatgttgatcgtggagcacagctccttgcattttaccgccagggcaatcccatttaactctcccatctcaatatccaggaacacgatatccgcctgattttcagccagataggaaagggcctcctgagaatcggaaaaactgacaatctccgctgccgcttcgacccgcttaagcatggtgacaagattttgcagagccagctgttcatcatcaaccgctataattttcattcacacgattcctcctttgcggcaggataagttttatttcagtaccggtgcctatctcactttttacttccagtcttccgccgcacatcgcatccagcctgtctctcacattttccagcccaatatgagttcttccgtcttcttttttctcacttatatcaaatcccacgccgtcatccaccacagtgatgaccaccgaaccgtctgcctgcccgctccggattgtcagactgcctccagccttcttttgagtgatgccgtatctcaccgcattttccacaatcggctgcagagtcagcggcggcagcataaagtcctggtatccgatctcccatcggatgcggaggcgctctccataacgcattttctccagatacagataatcttcaatatggtccagttctttttcaaatggaatcagccccgtattggaaagggaatccagatttccacgcagatagtaagaaaaatgttccagcgcgtccgatgctctctgtggatccgtatcgcagagctgcttgatgccaaccagcgaattataaaggaaatgcggctgaatctgagaaagcatgatggatatgcggctctgtgacaattctttttccagctctaatgcccgtttttcattttccatactccggcggatacggagaagaataaataagccttccagcacggcaaagaaaataagtcccattccgaaaaaaatgccagcctccagccactgggcaaaaccattgagtatttccagtatacccaacactccgagcggcagaagagcctgcaaagaagtgatgagggaccgttttttcagggctctgacttcgtagctcaggcagaagatcaggaccagcgcgacggcaatatccagcatggaaaaagaatcaatattcccgaaccaatcctgaattcctttcatctggaacacggccccaaccagcatggccgccaacagaactcccagcgcgccatacatcgtcttttttcgccatccggtaagatttccattcacaaacaggataagaaatactacaatcccctgaattgagcaggagtacagggtgttaaggagcacagggtatggcaggaacaaagacagcgccggagccagcgtcgcgaaccagacggcggaagacagcgtacaaagtcccagccagacaaactgaaggctgccgtgaatgtgcagcaaaaccaggagaatgccggctataaacagaaacagcgtgaggaccagaaatatcgttccaacagccagcagccctatatctttatgtacagcctcaaaaacaagggcccgctcactgccggtatacatatgccagagcagattgtcaaactggataaagtaggcattacggtagagattgccgaaatggagttccacctcatcttccgccgtaataccgggtgatacgaaggtataccacaggtttccaatagactgtgcggggtttccatccccctcctgtgggccaaaggaaaaggcttcctcaccgtttatccgcatggtgacccatagctgacagatattaaagaagatcttttctccctccggaatatctcttgtaaaatgtccgcgcaccgcaatgtcccgcagttcacggtaatcgaattctgtttctttcgaaagcggcttccattcgccgccctcctcgctgtactcgccctcaaccgctacgggatacactccgccgccgctccaatcacagctgaggtcatagtgaagcgcctgctgcagcatagcggcaaaaactccgaacagaatgataagcaatagaaaaaggggcaggaaaagccatgtagatttcgtatacttttttattctatgcatgaaaaggccccctttgatctgtgtttgtgtcttgcattgtcttatcttgatttgtcttgtcttgctttgtctttaagtatatcttaatattgctcaagtattataacatgttttggcagaaataatagcgtataatcgcaaaaacgccattcttacatttttaaataagaatggcgtttctgctatgaattataattgtggatcatgtattcaggaaaataccgtctggccccacacttcttccgaaatctctttaatcagcctcagtttattccactcttcctcttccgtcagcttatttccctcctccgttgaagcaaagccgcactgagggctgagacaaaggcgctctaacggtacatactgagaagcttcacgaattcgtctgaccacagcatctttcgcctctaactccggttttttcgtggtgaccagccccagcaccacctgcttattgctgcttacatactttaatggctcaaaatctccggaacgctcatcatcaaattccagataatatgcagacacgttctcctgatcgaacagataaggagcaatgggggcatacccgcctgcggaggcccatgtagaatggtaattccctctgcatacatgggtggtgatcgtcagatcttccggatgcccctctatggcaaggttattaaccctgacatatctggctgccagatcttcaatcgacgtttcccctttctggcgtgcttcccagtattttgtatcgcaaaacatgccccacgtacagtcatcaaactgtacgttcctgcatccggcgtcataaagatcctttattacctggcggtatgcggctgcaatatcctgaagcagagcctcctcgtccggataccaggctctggttttctccagattgtcgcctctctccagctcagccaggaactgggcgggtgcgggaatcgtctgtcgggccaggaccgatgaatcctcaaatagcttcacatacttaaaatgttctataaatggatgattctctcccgagattttcccgcataaacctgcggattcccccctcgtcacctcatcatgaaacgtatagccctgagtgacttccagtttctccacgccctggaggccccacataaaatcaagatgccaccagcttctgcgaaattctccatctgtaataaccggaaggccagcttttttctgtttatcaatcagctcctgaattgcctgatcttccacctttctcagctgctcttccgttatatctccttttttcagctgttctctcgcttctttcagataatccgggcggagaaaacttcctacaatatcaaatttaaatggtgcatgattatttttatacatacggctctcctttatcagttaaattcaaaactgatattatcgtaccgtaaagatggttatatgtaaaatcgttaaaaaatatagaagggcatagtttttacctatagcttcattgcaaattccagctctgttaagtcatccttccaggtatgattttctttttctgaaatcttaacaaaccccattctctgatacatgctaattgccttctccagatcgcttgtagtgtccagatatgcggttttgtaaccaacatcgcggcaaaaatccagcgcatctttcagcattttttttccgagtccaaggccgcgataattcggatgcagcaaaaaccagcggatctgcacgttttcaccacgtcctacaacaccgatacacccaataatatttccataatgttctgcaatccataatcggtcatgaccggaatcatactttaacaaaaattcataaaatgaatttgctacatacgcttcaaaagcggtcgtatatccgtattcctctttgtaaatccaaccatgcatcccgataatgaatcccgcatctcctggcttaattgaatgccttatcttaatatcttccaatctaatattttttccccctgtcaaaatacattcaacagatgtcatatcctttaccaactgagtacgctcacgatcagaaaggtgtttaagcataacattgatttgctcatctgaccgtgcattcagaattgtcataacctttcttccttcacttgtcaaagacaaatcataagctcttccatcttcatcggatttctttttctgcaataaacctgatttctgaaaactcgtaagcatatgacttaaataaccggaatccatgctaagagtatccacgagatatttagatgtacacttctccattttattaatttcgtgaagcactctaacctctgacagcgaatattcactgtcaagaaagttctgattaagcaggcctaaaacattcgtataataccggttaaatcctctgattgcacttacttcactttctctcttactttgcatcatacagtcctcctcaaatattactatcattaatataactcttttacttgtttattacaactattttatttgttttaagcaagcatttgagtattttactggatatcagtctttttatagaaccttatatgtgtattcttgagaacataaggattgctgcacaacaaaaaaaggtctctatcaaagaaagatagagaccccagactgtagacaactagcctcctaataggaggcggttgtctttttttctttaactcaggttttcgatgtagtataatagtgctatacgaaagtgaggttttttcttatgatggggaaaaaagattattcagaacgttctcaggtgcagattacaagcctggatgacctcgtcccttccggtcatctggttcgcaagctggaagaagccattgatttaagctttatttatgacgaggtcaaagatctctacaaaccttatggcagggaaagcattgatccggttgtattaatgaaaatcgtgatcctccaatacgtgtttggcatcccttctatgcgcaaaaccatcaaagagattgaagtgaatcttgcttaccgctggtatctgggatacggcctgtatgaggatatccctcatttctctacctttggaaagaactataccagacgatttaaggatacggatctttttcaaaagatattctcccggattctaatggaggtggatgcctgtggtttcctggatacggaaagcctttttatcgatggcacccatatcaaagccagtgcaaaccctcataaataccagaatgaaaccatgaaaaaagaagcccggtgttacgaaaaggagctgctggaggaaatagagaaggacaggctggagcatggaaaaaagccattgaaagaaaaagagtccacgccagagaccataaacaaaaaggtcagcgctaccgatcctgacagtggctggttccataaaggggaacacaagcaggtgttcgcttatgcagccaatacctgttgtgacaaaaataattatgtcatagattttgaagtgacagcggggaatgtccacgacagtgtatccttctgggaactgtaccggagagtaagcggacgggtaaaatatcccaaatactatgtaatggatgcaggctataagataccagcaatcgcaagaaggctaatcgaggatgaaaaggttccggttatgccctataaacgcccaatgacaaagaaagggtattttcgaaaaagcgattatgtatatgatgaatactttgactgttatttatgcccaaataaccagatactaaaatacagcacaacaaaccgtgatggataccgagaatacaaaagcgaaggaaaaaagtgtaaggattgtccgtaccaaaaccaatgtacaggaagcaaagaccatgtaaaggtggtaagccgccatgtatgggaggggtacatggaagaggtggaggagatccgtcatcagacagggatgaaagaaatctatcagaaacggaaagaaaccattgaacgggtctttgcagacggaaaagaaaaacatggaatgagatatacacagtacagaggattggcaaaagtgacaatggagctgacccttttatttgcatgtatgaatctaaagaaactggcaatctggaaatggagaaagggcgggctaaggaaaccctgttcttttgtctggatattcgaaccaatatatttatatataaaattcaaaatggttcctggtgcgatgcacccggaaccattttgtctacagtctgaggtctctatcaaagaaagatagagacccgacagcctgtgttcctgatttaaatcttatttccggcatttttattcactaattaagcaattatattttctcgtatgcaaccagcgtatccaacggaatccgtgtcttcccatgtctgtccggatccgccggttcttcatcagcatatccaatcacaaggatattgaccggttccaggttcgcaggaaggttgaattcctgtgaaagaatatccggcttaaaatagcatacccagacggttcccagtcctaattctgaagcctgcagcatcatgtgatcggtgagaatagaggcatcgatatctccagtctgcttcttatcaaacggacgggtccacgctgtgctgtggtcggcgcacacgataacagccagaggtgcattgtatatgttggcggccttttcgattttcgccaggccctccttttcctgtacgacaatcagccgcaccggctgcaggttcgccgctgtcggtgcaacgcgggccgcctccagaatcaaatccagtttttcctgttccaccttctgagacttatagctccgtaccgaataccgtttcttcgcgttgtctaaaaaattcatatgtaacacgctcctttcctttcatcttctatatggtctgtttgatatagctgcatgcagtgggttgatgtttccatcaacttcagctataattataacactgattttcctttaaacaagtatgcacttttagggtatgtagtacccaaaaagatactgtctatccgtataaaaggaatcgatagaaaggagctttctcatgagatgtcccagcacttaccattgtccagttgaggccacgcttgagttgatcggaggaaaatataaggccctgatactctttcatctggtggaaggcgccctccgcttcagcgagcttcaccgcctgattccacaggcgacaccaaaaatgctgacccagcagctgcgcgagctggaaacggacggtttgttaagccgcaccgtctatcctgttattcccccaaaggtggagtatcagctcactccttttggggaaacgatcttaccggttttggaggctatgtgcagctggggatccgattatttgaacaaatccggcagcaaggcccctttttccgcggctatcaatacagaaatgcagactgaatgacaatcagcctgcatttcttatttcaaagaatcgttcgtcccatgaaacaacagctccagaggacagcgggtcccgcttggcggactctttattctattgttattttgtctcgtcatttgaataagggccgaggatgctataaagcagatccaccgtttagacaaagcaaagcttggatataactttttctatctcactggcatctccggagccggacgtgccgtggaggacgcagttgaaagtgcaaaaataaggcgagggacgagctggaaaagctgcaggaactcaagcccctgaaaatcacataatttttactgtaatcttaaaatcacagcaggtccctccgtctcccaacgtctgggttcttccccattcaatcctgggatgcatgctgccatagcatatatcatccgcatggcagtatgcccttacaatctcctcacaaccataggctttacagatatcgaaatatggacactttatcatgtcgaatctcagtaccttatttgttgtctcatagtaaaccgcctgaaagcctgccttcggaccgaaattcgagcgggtcatggatttgaaaaactttggaacgagcctgcagcatccgggtatcttcatcagcttatgaagcagatccgccatgcgccggcttctccatgcataataatcctcgatgaaatccgcagcctgctctctcgcttctccgttggcagtcagtgcatcaaaggccgctatccccggataaatacgttctctcgtatgcatatacatggcctttggctcctgtgcgttttcttcgcagatctcccggtaccgcttccacgccattgccataatcgatgccgctttttcaccttcatagcgtttagagaggaacggtgccatctctgccagaaatacattctctttcttctttgccatattgatcccgcctttctttctgtcgcacagcacatccggatataaaaagccggttacaggcttcatgcgcctttatgcatctcgtcttttatatcgataaacagccagtctgtcgttgcaatccttcagtttaggcagggagccaaacagccatccgcgaaatgtataagtcttcatcacatcattaaagctgttttcccgcagcaaggtcagtccgggacacagcgcctccagctcttttcccgacttggtgccccaacggaaagtagcattggtactctttaaggtatcatgatgtttggcctgctttacagccatcggcggcatcaattccgccagcagcacaaattcagaaaatgcaccggcgagtatggaaagcagtgtcttcacctgttcctggctaaaatacatcagcactccttcaataataaaaatcaaaggtctccccgtttcaacagcctgggtccaatccgccttcaggatagagcctgcaatctgatgaaccctgccactttccgtaaaaaactgctttctcaccgtcatcgcatccggcagatcaatgtcataccacaggattcttccgttatcaacacggtaaaatcttgcgtccaggccgcagcccagattcacgcaaaccgcctccggatatttttccaaaaattgctttagcgcctgatcaaacatgatggttctggccacgacgccctcatgactcataaacttatcgtatttttctgtgtccatttgcagctgtttcatgatttccactgctttttcatctctgatcctggctttctgtcgaagggtctcattggccttaattaccagggggatcaacatagtttcctgtacaactccaagatttgctgtcatttctttatttgtcctttccagtttttgctgcggaacgcaagttagtatatactaaccatatattaccataagaccgcacggatgtctattgtctgtacatgagaacctttcgcaatcacaaaccagactgttgataaaaaagtatttttcgtgtaacctttctttatcacaaacgtttataggatgataaggaaaataaagaaaggggggccgcggtgaagaacgagacgctggaaaatatttatcttacttattaccatgaggtttacttatatacgctttccctgtgcggcaatgtccatatggccgaggatctgaccagcgagacattttataaagcgctgctctccctggaaggccagcggcagaatgtaaagttctggctgtttaaagtgagcagaaacctgttttatgaccggctgcgcaaagatgcacggcttctgcctgaactggcggatgagccgcctttgagcgggtcttccgacatcgtgtgggagcagatgctgaaaggtgaagaggccagagaactctaccgcgctgtattaggccttccgcccagatacagggaagccatctttatgttttactttttaaactacaacattaaagaaatagcagctctgaccggtcagaagccaggtgcggtaaagacagcgctttgccgggcacgcaagcagttaaaaataagtctgaaggaggaaatgtatgacatttaaggaagtgtttcagcgatacaaagaaggaaccgcctctttggaagagataaaattcgtagaggaggaacttgagaaattcgagcttctggaagaatacaccctggcgcaggtcgatgacagctgcccgggacttcaggaactcatgactgaaagtgatgaaaatgagatcaggggaattaaaaagacggtgaaccggaaattgctgaaaagcattttgatttcttttctggcagcggctgtcctggttctgctctccggccccatatgcagccgtattttctataatccgaaccgcggttatcaggaaacgtatggcggagacggtcagttatttattgatgcggcggtatttaccgagctgcactctcctggctatacgacgaattgggccaaggcggtccccggctttccgggcagctatcatgtggagatacgccagagcaatctcttccacggtcgcgaagaaacattttccggcagaatcgtgcgggggaaaatggcgggcagcgaagcttccctgaccggttactattctaatattttaaaccggacaggatctgtactggagacgtactggcattttcctcctataaatgcatttggccggaaattagaaaccttctgcactacggatgaggctggaaacgatgtgtatcggcagccgcaggaggaaatcgacagccagttagagcagctggaagagcttccttcctcctcctgggccgccgcctatatcacatttgacgcccccatgtccctggaggccttcagcagtctgtaccgtcagtgggtggccgatcagggcaatctggatatcacctatgcagccgtaacgtgcagcgaaccagggtataacatgaacgtcgccggatttgatcccgctggaacaggtgtattctcagaagcaggcgtctatcaggaagaaacgtatccatatctgaggccaacgacggccagagaactgaacgacggagaagcactggaagaaatctgggaacagcatttcacttccatgctgcagtatatgtctgacaggccgcagtttttaacagccatggccgatgtaaacgggatcagccaggaatattacgaagaacttgcttcctatgtgaaggatcatggcattcaggttttcggcgttatgattcagggaaatgtaagtcaggtgatctcctttgcagagcaggaaaaggtggatggtgtgtatgtggaagacgcgaaattgtccgcgctttcacggtaacatatcacaatcaatttctaagtaaaaattgtcagagtaataataaaatgcaggcgtaagattaagaggacagactcgtccgctcttacgtctgcatctattttctttcatgaatgtaacatttaccttccctggttccagcacctgcactgttcaatccgcctgccgccgtctccctgcgcttcatcatatgcaaactgcttcagcagctcacagggaaagtccccgcactggccgcaatgctcatgctcccgggtctcgcagcaggtttttaccggacatccgtcaccccaaaatggcttatcaatatgtacacagcctttacaccccatttcctccttataaccgcacgaactgcacaggataccgcatctggattcaatcattataaaatctcctttttgatttccattatagcagagggaacatgacagctatgggtcatgtctcccggtatctctgcaaaatattttcagactgccgtcggatatccgccctcagttcttccggttccaacacgcgcacctgatcgccaaagctgagaatccactgccgcatgttctgatagctcgcaaaatcccattcgaacagcagtcccccgctctcgcaaggcacgtagctgtccctaccgtattcttcaatcagacggtgtctttccgtttctgtaaatatcgccttcaagcgaatcgtatgggaggaaaagtaagcatcaaaatccagccgtttctccggaatctcgcgcggaacaaagtgttcctccaggacggacaagtcccataggcggttcagcttaaagagacggtaatcgtttctgctgtgacagtatccaaaaacgtaccacgatgaccatttaaaaatcagccggtatgcctcaattctgcgctggctttccccattttcactgtagtactggaaagagatcatgcgcctgcaccggactgcttttttaatcaggccgattttgtgtgtcaaagcgtcgtggtaatgggacgcaaggtcaatcaccatggtatcgtcaacgacaatctgccgttccctgctcgacagcttttccataattccactcaggtatgcgcctggggatacgctgtcaatgccttttaaaccggttaaaatggtctgcagttcatcctgcgtaaagagcgtcttgtctatcttatagctgtctgagatggagatgcctccgtcaaatccctgaatcgtgaccaggggaatcccggctttacagatcgcttctatatccctgttgatggttcttctcgaaacctcaaaacgcgccgccagctccggagcggtcactttgtcctgctgcagcaggattgtaataattccaattaagcgttcgatcttcatatttttatcaccctatgacattgtatcacaggaaacatgacattacatagtcatgaatttaattatatttctctgcccagtccttcagttcctttactcctgcctcagcgttaaatcgcctgccttccatcaaaacagcacccttacaggaccccttcagctctgcatttgtatttcccataccactcatacccgatgttgcaaacggaataatcttttttccttccagatcatactgttctaaaaatgtatttataatagtaggagctacgtaccaccaaattggaaatcctacatagataacttcataccgccccatatgctcaactttattcgcgatctccggccggaaagacttgtcgctcatttccacactgctgcggctcttcttattagtccagtccagatctgcggcagtatacttcacagcaggttcaatctcatgtaaatctgcccctatagcggaggccagcgcttttgccagccttgcagttacaccgctggccgaaaaatatgcaactaatactctgctcatttttaaatcctccgttttctaaatatatgtaactgtttctgatattttcctgcgctgtgtatgcgcagcaagcggttttgatcccttttccgcatatccaatatcaagaatcataaggatctcctcattctcaggcagtcccagttcttttgcagttacttccggatcaaagaaattaatccagcagctgtcgacgcctgccgcctttgcagccagcatcatatgagtcgccacaatagctgcatcttctacgccggaattacgtgtttcaccggggtaggtaaaaacatgattcttgtcaaatgccaccaccatgacagtagctgcgccatatctgcagggagtcaccttatcaattttggataggcctgcttctgactgaacaacatagatacgctgttcctgcaggtttttcgccgttggtgccagtctgccggcctccaggatcatattcagctgctccctttcgactggacggccatcaaaattcttacatgcgtagcgattcttaattacatcaaaaaattccattctctattacctccttctgaaaataggtgccgcaaagatttttcattattctctatgctgcacctatatattaattccatttttctattatgtctaatgcttataattcattattaggaatgcttatttcgtatgactaataagactgttatcgatacggttctttcacgtaccggataaaagcgtttgttgcttttgaacagggctgttgatctttccatgcaagtacggaactgagttccagctttggatcaaacggtaaaaacttcatatcttcataatagcagtccaattttacacagattgctgcccccttccgttccctggctgtgatcactgcattataaagcagattataatttacgcaggattccatctgttttgcaaaatctccggaccatcccgcaagttcgtgatgtaccggagtgttcagatgaacggttacaacctgtgttcccacgaggtcccccggctgtatgacattccgtgaggcaagcgggttatccttatgaatcagaactccccactgttctttcattttcattcggataaaatcgtatttcacaatacttaccggctctaaaagaagccccatatccagagcaccctgttccatccgttctttgatgtcttcattatctccgctgtataattcaaattttacgagtggacagcactcctgaaaaccggttatcagctttgccacttcctgcacgctgcgtatttcaccacagccaatcgcgatgacaccagacagagtttcttctttctgagtcagttcctcctgtgctttctctgcaagattcaccagttcctgtgccctgcggcggaaaatcataccttcatcagtcagataaacactatggttgcttctctgaaacagctttactcccagttcttcctccagctgcatgagctggcgggataaggttggctgcgtaatatgcaaaagctgggcagccttcgttatattttcttctcttgcagccatgagaaaatacgacaatatacgaatatccatctccatctccttttactggcttcccatttttcccagaatcgtaatattctcggaaatctgcacctctatttcataatctttttcagatacttccctgtaaggctctcctcactccgcgatatttcctccggcgtaccggccgccacgatccggcctcctgcatcacctccgcccggccccatatctaccacatagtcggcattggcgatcatatccagatcgtgttcgatgacaataattgtggctccggcatcgatgaacttctggaatacgccgatcagcacccgcacgtcgaggggatgcaggccgatggtaggctcatcgaacacaaacacggcatcatcctgggccttgccgatctccgatgccagcttcaaacgctgggcctcgcctccggacagggcaggcgtcgcctcccctaaggtcagataacccaggcctaaatcagccaggacctggagccgttctctgacctttctcacatcacagaaccgctccagcgcctgttccaccgtcatgtccatcagctccggcagggatatgccgtgggagcggaacgcagccgcttcctttccatatcgggaaccgccgcagtccgggcagacaatctccacatccggcaggaactgcacatccatggtgatctgcccggtgccctcgcatcctgcacagcgcagggaaccggtattgtaggaaaaatcactgaccctgcatccctgttcttttgcctcaggggtggccgcgtaaagttttcgcagctcgtccagaacgccgctgtaggtcgccaccgttgaccggacattgattccaaccggcgttgagtcaatgaggctgacccgcctgattccgggtgcgtcagcggctttcacatgatctggcagccgtgtgccgccgccggacgcctgcaaagcagggatcaggctttccaaaatcagggtcgtcttaccggaaccggatacgccggtaaccgccaccagccggcctttcggaatatccaggtcaagggcgtgaaccgtatggagcggagcggttgatattctgatatgtccctgttcaaacattctctccgaaggagttcgtttacggattagaaccggttcctctccggtcagaaatccggcaatcagcgagtccgacgtttctgccacgtcttccagacttccctgcgccagcacgtttcccccatgctgccccgctccgggtcccatctcaatgagccagtcggaggccttcaatacccgtgtgtcatggtccaccagtacaacggaattgccgtgagcgatcagatcgtccatcataccgagcagtccatccacgttagccggatgcagtccaatcgagggctcatccagcacatagagaactcccgtcgtccggcttcgcactgccctggcaagctgaacccgctgacgttccccggtagaaagcgtatctccagcccggtcgaggcttaaataccccagccccaggtcggtcagccgcctggccgtatgcaggaactggccgcagatgctctcagccatgtcccgcagttcttccggcatggatgcaggaacggccttcacccagggaatcagggcatccaatgtcatagcggcggcttcccccagtgttatcccgcagagcagggaagagcgcgccctttcattcagcctggttcctccgcagaccggacaaagctcctgcttcagaaatttctccacccgtttcatgcccttgtcatcctttaccttcgccagcgcattcgccacggtgtaaaccgcgttaaaataggtaaaatccagttcccctgcctgattacttttcttcgctttgtataaaatgtgcttcttttcagccgggccatggaagacgatctctcgttcccattttgtaagctctgaaaaagggacatctgtgcggacccccatcgccctgcatacatccgtcatcaaagaccacattaaagaattccagggcgcgacggccccatcgtctatggaaatggattcatccggaaccagcacggcctcattcacagttctcacgatgcctgtcccaccgcagtttttgcaggctccctggctgttgaaagaaaagctctcggcgctgggaccgtcaaatgccgccccgcattccggacagtgaagcggttttccgatggctgtgttcaccgtcggctgaagcaaatgaccattgggacaccgatggcttcccagcctggaaaacatgagccggagagaattcaaaagctccgtagatgtaccgaaggtgcttcgtacccccggtacggcgggacgctgatggagcgccagagcagccggaacatactcgatgctgtcgatcctggcctccgccgcctgtgtcatccgcctccgggtatacgtggacagcgcctccagataacggcgggacccctccgcgtacaacacgcccaaagccagcgacgacttgccggatccagacacaccggcgatccccaccagcttccccagcggaatatccaggtctatattttttagattgtgaacacgggcaccccgtatcttaatgtgatcaggcatagaattcactccttgctagattttcaattattatagcacaggaaagcgggcgattctatatggctcagtcagctccggcaatattttttatttattctattttatttttccagccgcactacgttccagctatgtctacccagcaccgaagtaaatataccattttccactctggaagcagccgaatgtaccggttttactgtatcaggcgccagctccgtattctccgccttcagatcatcatgagtcagcacgaaatgttcttttacctggtaaccctcaaactggcgtaaatcgcactcaatttctgcatcttcctctaaatctttgtttactgcaaaaattgtaagtgcgtccgcctcctgatcccagatgcagacactatccaggatggatacctctccatagttccggctttcatagaaaggagccttaatctgagtcagcaacacggttcctttcccgtaaatgctggcatgcatatatggataaaagatcgtctgcctccaggcccctgtgtccgaggtcatgataggtgcgatgacattcaccagctgagccatacacgcaattttgattctgtccgcatgcctcaaaagggtaatcagcatgcttcccactaagagggcatcttcaaagttatatacatcttcaagctgatgaggcgctttgtcccatggtttgatctttttatcctgttcattgctgtggtaccatacattccattcgtcaaaagataagtgaatgctcttctttgcatgtttttttgccttcaccgcgtcacaaagggataccactccagtgataaactcatccatgaccttcgaactggcaaggaaatccggggtgttattgctgtgattttcaaaatactggtgcagggaaagataatccacctcatcgtagcactcatccaggacctgatattcccagtctccgaatgtaggcattgccaggccggagctgccgcaggctatggtctcgatgcccggatccagccatttcatcagcctggaagtctctgaagcgatccttccatattctcccgctgttttgtggcccatctgccattttccatccatttcattgcccagacaccataccttgatgttatgcggctctgcatagccgtgagccctgcggagatcgctgtaataagtgccgccttcaaaattacagtattccagcagattcttcgcatcctccggccctcttgtgccaagattgacggccatcatcatatcgcttcccgctttttttgaccagtctgcaaactcatttaaaccgaattcattcgtctcgatcaccttccaggccagctctgtccttgccggccgctgtgctttcggccctacactgtcctcccagtgaaaccctgatacaaagtttccgcctggataacgcacaatgggcactctaagctcctttaccagctccagagtatccttgcggaagccatgcacatcggaattcacatttccttcctgatagattcccccatatacagcacgccccagctgctcaaggaacgaaccgtatattcttttgtcaacatcccctgttaaaaaataacgatcaatgataatttgtgctttcttcatgttctctccttccttctaattcaggacacctcaaagcagtcaaaataagcggaaccgccggttaccttcgtcgcatagctaaacagcgcaaatcgataccccacaaaatgggtcagccggtatgacatctttaactggctgccgatccggttccagttgctgcagtccaggctgtaataaaactctgcggtatccgccatatcccgaaaatcaaagtcaacgcgaagatatatttcgctctgctgcagcgctgtgctttccacaatcacctccggctttccggtctcatagtgcatcctggaaggttcaaacggttccggctccgccatcgccatgatcaccttagccgaagcctccgtcttcatgacgccgacgtatccatactgatcctggaaagcgccaaggccagcgaaatctcccgccttcatctccgatgtatcaaggcgcacacggccggaacagacaggcccaaaggtcctctgtgtcaatgtgttgtgcgcattggacaggttgtcgcaaatcgtaccgtttattaatttaagccatcccggcctttcactcagcgaccagaagcggtcatcacaattatgattccactgccaccacagtcccagcgctgtctgatcatcaaacccatccgattggacaacatcaattctgcaaaaagccttagaattcactgtgtttatatcaggcagccgtccacagtctccaaacaccggccagccgtcctcccaggataccggaacaagcaccggtattctgcctgccgaaccgtgatcctgaaacagcagcgcataccatttaccatcttcagtctcaaagattccgccctgtgcgactcctctgttatgaaatcccatatcgctgtccagaaccactcttccctcatacacgccgtcaattctgtctgagcggtagcacagctccattctccttccggaagagcggtccgcaggaggccacgcaatcagaaatatatagtacatgccattccgtttataaatatgcgccccttcggcaggaaggccgcctgttcctcccacatcagcactcggaataatcacctgattcaagccatctgctttaaccgccttcgcatcagaggttaattccatcacacggattgtcccgctgccgtataccatatagactctgccgtcttcatcaaacagcagggacatatcgtggtaaatgccgggaagcgtgtatctctcccatggcccgtcttcgatgctttgggtctgaaaaatatacgttttattggcattatatgccgtaaacacaacataccacgtatggccggcatgtctgatgcagcttgcccaggaccctctcccatagtcgtgttttccatttcttaaagacatctcatcgctgttttccaaaacatcatacacataattaacaatttcccaatgaatcaggtcccgcgatctcataacaggacagcctggcgtaaaatgcatcgtcgtgctcgtcatgtaatacgcatcaccagcccggaccacatcaggatcgggtatatccgtccaccacaggcgcgtttctctggtctctttcatcggctgccccccactactctaaagagaaggaagccagactgatcccgccctcgcctttgaattcgaaatacagcgcaaggacaccatccggaatcgtaatctcagcagaattttccacccatacgttggaatagcctgccggaatcttacccaggcactcaccatcccatctggtttttacttcaaaataaccgctgccatagcctcttgttttcagcgaaatcctcgtaataccgctgcagtcaaaatacttgaatcctgcgattgtggaatcctgcatattggcgatgtatccggtctcttcatcgccatcccgtccatcctgtgtgattctggcatattttccgtcgatccagcctgcatggtggagcaagtgattgttatccattgtcttagaaaatagattacaggcaatatatgccggatactctcccttcccggccagtgggcctccatttaaaccgcatgaggtcatctcgacctgctgtatggaaccatcttccccgatctgaatcggctcagcgcagccctggcggctgaaattagttccgtttgtatgcctgtggtaaaagatataccactgtcctcttatttctgccatcccgccgtgattgttgcctggaacatacgcaggaaggccggccggcttctggtgcgtgatgttaccatcgcaattgctgacaatgactccgccatacacatattctttcgttggataccggctgaccgcataacacaattcatgcattttactcgaagaatagacaaaataatacgtatctccattctttctgattgaaggaccctcaaagaactcatgtccctcaaaatcagttccggcactgtaacagtttccgggaactatgatgaccggttcctccgttatggtcaccatatccggcccaagcacggtcgccatggcgcctttccgcgactggtcgccggggccgcaaaatcccgtatagagatagacgctgccgtcctccatcaggactgccggatcaaattggggctgatcgctgtcccgttcccccagacgtctcccgtctgcatcgtgtacatatccatagaagctgtattttcctgcgggtgtatcactgacagccaccgatacaaacggaactttatcgagaacataatacagatagtatcttccatctgcgcccctgacaacgtccggagcatacaggcacatgctgccctcccggtttaccggatcgctggtcttttcatagataacgccttcatatctccaattgcctaaatcgtccgacggcgcggaatagcatacataatcatttaaacaataggcaaatccattaaaacggtcgtgggatccgtacacataaacacggtccccgaacacatggggttcaccgtccggaatatattcccaggaaggcagatagggattaaacgcctgttttttcatactcatcccttcacacctcccaatacaattcctttcacaaagtatttctgaaggaacggatacaccatgacgattggcagtgatcctaaaaatatctgtgcagaacgaagagtcctgtctgatattgtagccatctgctggatctcttctctcgtcatcatactgaacgaacgctgaaccgcaatggtttgtatgtaagtctgcagcggataattgtcaggattgttcataagaatcagtccgtcaaaccagctgttccagtttgccaccagagaaaacagcaggagtgtggccagagccggtttggacagcggtacatagatcgtccaaagggtgcgccaatgccctgctccgtctataaatgccgcctccgccagttctctcggaacttcacggaaaaagttgagcaggagaatcacactgaagacaggtacggcgcttggaagaatcaaagcccaaatactgtccagaaggccaaactgtctgattaccatgtaccacggaattaaaccggcattaaatatcattgtgacaaagaaaaaccaggcgtaaacggttctgaaccgaaaacttcccttcggctgggataatggataggcagccgtaattgtcagtaacaggcttaagcccccgcccattataattcgtataacggaaactctcatggagcgccagaatgcgggacgctttgcaacgaaggaatacgaatttaaggtaaactccttaggccacagcgatacggttccggccgaagccgccgcgctggagctaaaggaaactgccgccacatggatcaggggaatcacgcagatcagagccagtacgagcagaaatgccgtatttaatattggaaaccacttaaacttcttcttgcttttcatagactgctcctttcctaaaacagctgatagtctgcaaacttataggcaaatcggtaggaaactgagattaaagtcagagatatcactgatttaaacagtcccaccgccgttgcaacgccaaactgtgcctccagcatgccgatccggtaaacgaaggtgtcaataatatcaccgctggcatatacaggcgggctgtacatattaaacacctggtcgaatcccgcattcagcacgttgccaaggctcagcaccattaacagcacaatcaccatgcgcatgccgggaagtgtaatatgccagatctgcttccagcggttagccccgtcaacctgggctgcttcatataagcttaaatcaatgccggtgattgccgccagatatacaatggttccatatccgaaggacttccaggtctccgttacgatcagcgtaaacgggaaccatttattatcgcctaaaaagaagatcggctggccgcccagcgctttgataacctgattgacgagtccgtctcccggcgcgagtatatcgataaagatgccgcctaataccacccatgataaaaagtgaggcagatagatagccgtctgaatgccttttttcaaggaattatgtctcacctcattgataagaatagcgactacaatcggaattaaaagtccgaaaattattttcatgactgcgataaacagagtattccacagtacactggtgaaattgggcagtttgaacaaatagataaagttatcgaagcctatccacttctgatctccaaacagtcccttcgccggtataaatttctggaaagcaatgattatgcctcccatcggcaaatagctgaaacaaatgagcataattacacttggtaaaatcatcagatgcagcggcagttcccgctttcttctgcttttcatagaaaccctctctttcctgtttaaaaaacgagaggaaaagtttttatgaaacctctcctctcgtaatctcttttctagtttttaacggactggtaccattcgttgacttctgctgtcatatcagctccgccaagagcattccagttttcaacgaatttatcaaattcatctatggaaacatctcccataataatgcggacaaacatttccagttccatcgtctttaaagaggattgtttatctaccatcgtcggtgtaggcgcgcctacaaactcttctctcatcacctgaccgttctcaatataaccattcagagcatgaaagactccattctctccgtatatcttatcccatccccactgagtcgtatcgccattgtaataagcttccagattggtctgaataactgcaggctcaccctctaaaatgctcatatctcccagcttacgcgccttttcgatttcattaaacgcctcgaggtttttattcgtcggagccggtgcaaccggggagaacttccatacgcctaccgctccgttttctaccggcatgtaatagtgattaaagtcattgtcttcgccccagtttttctccagatgcatattgatcaatttcacaaccgcttccggattctcataatctttgcggactgcataataccactgggtacggaatttctgaggaaccttcggaagcgtatcatcggccgatacgatcggatatccaacccagtcggcctccggatcattttggtaattgctgatcagcggatacatcgggttccactgctcaccaaaatctattcccacttttccggccgctatcgtctctgcgacctttgccccatccttaataccgaattccgggtcaagctctccagccgcatacatatctgccagagcctttaatgcgtccttggtttccggaagcacactgccccacgccaatgtcccatcgtctgtcttcacccacatattgggataagaatggtaacctgcgaaaaagccttccgtgcccatggctccgctgtataagtcttttgtaacggccattgcatacgtgtcatcttttccatttccatcaggatcgcgtgtggtaaacgcatccgcaatattccgtaaatcctgcatcgtcttaggtggttctaattgtaacttatccagccaatcctggcggatccagagataatgtgtactctccaccgatgcatctgcataggggactgccatcaaatggccgtcaaaggtagccgactgcaggataccaggtccttccgaattataaacctctctcgtcagttcactggcatactggtcataaaactctgtcatatctgctatcatgtccgattctgccagctgcttcagctgtgtacggtttacaatcagaacatccggcaaatcaccagaggcaatggtaacattcaatttctgtgtataggcatcatcgttaagaccgcctctgaccgtccaggcataactgatgtcaatccccagatcatcggaatacaagtccagccacctgttgctgtcgatggtctcccccggagtcttaggcagaatattgtcattcaaatcattatccaccgtacgtgcaaatgtcatactgatcggtggatcatactttccaaatggatccgcgctctccgcagcagcggagctgtcccctgccgctgcagtactcgtttcacctgctgcacttgcagaagatgacgaaccgcccgaattatttcccccgcaggcagtcagcagcatactgccgatcaatacagcagatataccagtactaaaaatacgttttctcatatagccctccttgttttatgatttatcaccaatttgtacccttattatacccgtatttttagtcgttttctacaagcaacttttgattttcttaacacatctttactatatttttttctcgtcttcacatatttttacatctgcgttttaactctcatgtcttttcgcagagtgaaacgtatcccggtattcctggggcgacataccttccgcttttttaaacaggcgtgtaaaggaggcggcggtatcatagccaacctttcttgcaatttcgtaaattttttcatacggattttcaagtaattccttcgccctttttatccgcgcatgttctataaagctggaaagcttatggccggtcgtctgatgatagagccgggaaagataggaggaatttaaatatgttttttcagacaggctcgtcagggataaatcttccgacaaatggccttcaatatactgctgcacaaatgctatgatctcatgtgtacgcttacactgctcttctttctgtaaatcaaaaagcttatgaaataattccagaagatgatcggccgcctccttccaggtgccatagctttcgctgtcctgcagtttattaatattgtaaaattcggaaaactgagatgccagctgggaacggttcatacaggaaaggaagaaggtgataatcgtctggtatgcctccaatgcaataccatcatttttatcctgtatttcgccgaggggcaccagccatttttttaaggaatcaaaatagtcctgctcttcccctgtttcaatggagtgatataaatcgcttaagtctttgcggaataataacccctgcagctcagccgccgcatggtcagcttttgcgtcctgaaccggaacgaagttctgcctctgcttccgaaaatccctttcgtcgagaatagtttccatatcatggctgatatggtggctaagtaagtccatcagggatacatacttctctgcgatctccttccacccgcatggcctttctgccaacgcaaaatttactggggcattcagcttctcccgacaggccgactgaacgatctcaagcgttcccttcaggaaaacgctcatactgccgtcatcacgctccgaaaatggctgtgtctttcgaggctggacaaaaacagcaatcttatcatccttcagcgggacagcaaggctgtcaacgtgcatggaaaaatatctgacaagcagttgtttgatcgaatacatgatctgatttttctcccagaaatcaatcgacttgggcagcgtcagtatttcccccagaaccagcatcaccggttcgtctgctttcaaatggataaagagccgttcgaattcttccgtattgatttttaaagaatgatcactgttaagcaatgcataaaaatacttctggcaaaacaaatcctgagcaagattaatctgatctttggcgttttgaatcatctcattcgtttgattctcatctttcagctcctgaacaacgctttccacggtctttataatcttgtcatatccctctgtctttaataagtatctcacattactgtattgaatcgccttatacgcatagttgaattcactgtgtcccgtcaggaaaatcacgcggcaccaggaccagcgtttcttgatctcatccagaagctgcaggccatcgatctccggcatattgatgtcggtcagagcaatatcgatcctggtccgccccagccactggattgcctcctcacccgaatacgccttatacacatccagttctaaattctccagattggagaaaatgtcatatagcccatttacaataatttcttcatcatctgcaattaatagccggtacatactaccccctcctcactcccagtacaagttctgcccgcagtcctcccaatgaactgcgtttaagcagcacgccgctggcttcatcgtactgtaactgtaaacgtctgttaatattcagcagtgcagtcacttccacatcatccgattggactgccaatcgattttgcagttcttccagcgtttcatccgtcaggcttttgccgttgtcttcgacaataatatgcagcctgtcctgacatatctcaaaggatatggagatgatccggtccttcattctcttatcgaccgcatgttcaaaggcattttcgatcagcggctgtatgataagccgcgggaccggatattgttcgaattcttccgggcatggactgaaatccacttcgagattctttgaaaaacgcatggtttgaatgctggtataagtgcgcgcatgctccacctcctcacaaagaggaataatgtccgtggaatttctggtaaggtagcggtaatactcccccagatgatttgtgaactctaccagattttcgtcccccatttgtgccatcgtattgatgataaagaaactgttatatagaaaatgaggtttgatctgtgcctgaagctgcttcagttccgcacgctgagtcagaattttctgcttatatgcctgatcgatcagcatatttaagctctcaaccattttattgaatctggtgtataaataagcaaattccgtggatctgacgtcctccggattcagactgatctgcagattccccttttccacctggcgaaaaactgctaccaggtttttgatcggtttattgatgaaacgatgcataaacagcgtgaaaatgatgactaccgttatcgagacaaggatgaagatccatatccagctggtaaagttctgcattggcgtgaacaccagattctccggcagatatcgaagcagcagcagacttaaatagtccgacctcgcatacaccgagtagtagcggtaatcgtcaattttacccagatcggtaccgcttttaccggatatggcaaaatcgctcaatatatcatggggctgcagggatcttccggtgcttgccatggcaatctcattcgaattcgtcagatcaattaaaaatgatccgctgtccggatagatattgaactgctttaaatcctctttaaatacatccggattcagtttcacttctatcacatagttactgttctggcctgaattgtccaaaggataggcagtcgtaagatataatccgtcctcataccggataatctgtgctcccttaagtccggctgcggccttgatccgttcataaaccttcgggtctatttcatccacaccccggtctgacgatacggtcttatcaatgaaaaagatgtgtgcactgacattttccacatagctgctgctgtacacgatcgtcataagacgcgcctgaagctgcctcatattgctgacaatatcgtacggactcataatgctgtactgcactgcaaggcggttaagatgctcgtcgttcaggcacgtatactgcagtatcttgagcctttcgatttcatcctcaagctggtttaaatagaattctatttgggccgttgatgactttgacaattcttcccgcacggtattggccccccagttgcggatatagatgcccagaataaaaataggcgccagaacgattaaaaagagcgtgattattttcttaaacaggctgatattgaatctgcgaacgaatgacagcatacttccccctccaaaatatgacgtgttatatgaaacgctgtatgacatgttatatgatgcgctgtacgacatgttatatgatgcgctgtatgacatattacgctgtatcaatgatcatgcagtgatatactgaatttatcatatcaggtctgtttggttttaacaatcctatatttaacggctgatttggtggcgaatgcttaagattgctgcctatgcttatatattgctgcctaaggttcatattgctgcttctgcttcatattcccctcatctctgctataatgaaataaatttatatttgaaagggcggaatcatgtgaagctattagaaaaatactgtttaaaaatcggttatatcgatggtttatatacatacatcatctctcctcaattttatgaccgtattctcgaggatcacgaattattaagtcatttaaagaagtctccgacagagctgagaacattcatcaaacaggcaagggaagctgccccggaacaattatatctggcatttacccaccatccaaacaggattgaaaattatcaatggtcaacgctgcactgctttaaaaacggggaacatttttaccatgtgttctttcgaagctcctggctgtgcagagaatgcggttatctgtatcaggctccgatcattatgcccatggccgaggccgatgcgatatactacagcggcacgaaagacaacgatccggcgattccgtccattttcaggaaaataaactgcccgaactgcggaaaaccgctgcaaaaccatcttcttgatcttcattaattattataagagcataataaaaataccctaatcacaggattcagaagaaagtctgtatcttacgattagggtatcatttactttttatttctgcctgccgcttttcctgttctgcctgctgcttttattcatgcggcatacgctcgtcaatatccgttatttttccaataatggaatctatggcgctgctcttatacagattctgatactgcaccagacaccagaagtattcttcggtatccgggcgcatcacgcgcactcggatttcgccgtattccccaccagtctgaccgctcagtacacgctgaacctcctcctgatctcccgcgtaaataaacgcccggtccagcccattcagaaaatggttctgtgtcagctcccggatctttaaaagcttcgatgcattggaggtgaagcggatggtatcgtgcctgcagtcatagtcaaacagtaccgtatctgaaaagtgttccagcagaagatagcgctgctgttctaaggaaatcctgttctgaactctcacccagaaaagaatcatcgccgccgaaaccagggcaaccgccgcaatcagcccggcgatactccacatcatattgttcacaatgtagcgcaaatgcatggttgcggcatcggccttcaaacagacgaccagataccagtcgttatatctcagcccggtcatggataagtaatacggactcccgtcaaatctgcctgcccggacacttctcgcctgggaatcccctgcatcataggcgtcatgaagctcctctatcacctctttttttactccatagatatctaaaagttccaggagactctcaccaacgcctcttccattcggttcccggatcggaagaatcctgctgtccccgtcagtaagaaatacattgcatatctctcccagccccgggtcaaacagctctgtagatatcagcgcctctgcgttgataatcccctgcaccgtgccaatgaacaccccatccttcatcacaggaactccgactccaacgcagtagatgtctcccagccgctcagaataaatgatatctgtcaccactgtctcgcccagtttcaggcgttctaaaatttcactgtcctccggccttgcctccccgctcgtaatcagctcctgatacatcccgtaagtataataggtatactgaatcttcggactcaccttattcagcgcactcaaaaatgtattgataaattccggctcgtcattttccataatcaacacggcaaatgactgtagtgtattcacaacaccatcgatttccgtcagggtattttcgcgctgtcccgcagtgtaagcattcagcgtttcgattatcatgctggtaaattccttctgcgtccggtttcggttcacggtcatgacaccggtgatgcagactcccaggaaaagtgcacagcaaagaatgacgataacataacttttaatcttactctgcgccccgcctccgtcatccgcctccttcgtctgttcggactggtgttctgacttatcggagcacagcagcgcgggaagcgaatattttccgccctggcgttcacagacctggcacagttcctccggcggcagcggttttgaaaagtagaatccctgcacgacggtgcagcccagccggagcagatagagacactgttcctccgtttccgctccctcacacagcacctggacatggagacggtgggcgatgttgataatattgggaacgagcgcctgattgcgtttttttaacagctcatcatcggacaaaaacttgcggtctagcttcaggcagtcgaagttcagttcctgccatacattaattcccgcgtatccggaaccgaaatcatcgatggagacgtgatggccgtaagccctcagctgatcgatcaaatgcttggctccggcgaattcctccagcagaatggtctccgtcagttcaaattccagaagctcaggcggaatcccatattcggctgcaatctggtggaacacatctgccgattcgggatttcgtatatggagacgcgacaaattgaccgaaatgcaaacaaccgacaatccccggtccatccggtctttcaggaactcacagacctgtcggcagatgatctgatccaactcaatcacagatcccttcgcttccatcagatccataaatttatcgggcggaattacagtcccgtcatcaccgatacgccttgccagcgcctccgcccctatgatcatcccgttcgtcagatccaccttcggctgcaaatagaaacagaaacggttttcatggagcgcattgtagatttccagttcattttcatgcacggctgtaatctgatccttcatggaatgatcgtaaaccacggttttgaaggaatactgattttttgatattttgcgcgccagatttgcattgtcgatggcctgcgcgatattatcatgctcaatgaggcagaggccgcaggctgcttttaatcggcatgcaggatatctcgactgcaaatccgtgaggaattcctgcagttctctgtccaatccgctgattatttcactgatctcctgtccattttccaggaaatagagtcctacaaaaaagtcggcaaacaagcggcggcacaacagaatattgggccggctgtccaggaaatgattcatttcctgcagaagggaatccccgatttcatttccgtaaatgtaattaaccagatgaaaatccgtgatgtcggtataaagtatataaaactgtccatctgccgttctctcttgtattacacgctccgattcttctataaaatagtcattctgcttcatattccgtctttcctttatcagttggatgacagcgtgtatcttataatgcaaattatacgaattgcaatggtaagattactgtattacataagacgttttgcagatctggtcatcaggtctgtttttttaatctctttttctgccaggaaaatgatttttctttcattatccgatgtgattggtaaatataatttgcattataagaactgataaaatgttccatatattaccataattgtactatatcttctgacttattacaagacgccatctataagacttttcgtaacccgatatgcaaaagtaaattcgttccctggtaccatttcatggtaaggaacgttttgaaggaaatgcatcgagggaaaatattggaagaaatacattggatgaaacacactgctgctgcaaacaggtaaccgctgatactgccatgtatcttgcagccgctcactcaatatatcctataaataaaatcaattccgtgacaagatcacaaaaaagaccaggcgcacgcttccacctgatcttttccatttcgtcctctttaattcactccaatcccctcaaattcttccttccaccgaatcgtcagactcccatcccgaatcgtaaccggcaatatcgaatagccggaattttggagattatcgggaatccagtgatcgaacataatatagatctgttctttcacccgaaacatgtaggtgcactgcccgccataggtttcacgatacctctcgccttcacagggattgtcgattaatttccatttacccagcagaaactccgatcttgcatagagtgcgctgttataagcccagcctgtgcagcccgatgtaaccatatagtacatgccgtcttcatagataagcgcgggtgcttcgcgttcctgatcgataagcaccgactgataaaatccggttacatccgtgtaatctccggtcagctcagcaatattaagcgtcttattccagttggagctgtgcactaaatatgcagaagcatcttcatcaacaaaaagcgtcatatctctgctgtcctgtctgtttggctgcttttcatgaataattttaaagggtccaaccggcgtatcggaaacagcgactccgactccggcatatacataatccggcgtgtccaggtggaaccacatgacaaatgtgctggtcttcgcattatataatactttgggcctttcgcagacattctccggctttaccaggctgcccggcagctgatccgccgcggataatgccagtccctcatcgtgccaattcactaaatctttggaggaatatacgctgattccgattacatccactcttgtcagccctggtgtattgctttgacccttattctcaccataccagtaccatgtcccctcatgttccagaatcattcctccatgcgcctgaatcggcttacctgaatcatcataccaaatctgtccatttttctgcatagtttctccttttctgatgtgtctcgtgaaatgatacatgaatcttatgtttttctattgattatgtttcatatcctgaagctctcgtaataaccgctctggaacagtaacgccccggctgatctgctaagattataccatagttaatcgtcttgtgaaaaccacatggcggaagattatgtcgatatttcaacttttgccaatgctctgttacgttataaagcgaggctttctattgtctaatcacgtaataaatgttaaaatgaaatatcaaggctctatttcgattatataaaatactgaggtactggaacgatggatgcgattcatgatgaacaatggataaaagagaaatatgaagagatctgcaggcaaaatccggccgattacgttctaatcagcctcaaaatcaaacgttttcgcatatttaaccggctctttggacgggaggccggggatcggctgctcgagagggtctatgaagccattcagggctggatcggggaagaggaatacgcggcccatctctatctcgattattacaatatgctggtgaaggtgcctcacgattacagcacgatcgtccggtacgtcaccgatttcagccatatgatacgggatatgaaggacgatgagggatttggacatgtgtttatcgggttaggcatctacccgctggaagacgattcgaccgacttctatacggcccagtacaatgccgatgtgtgccgagctgagtgcccggagagagcttaccgcaactctcattttgaaatatactccatgacataccatgatctgaatctgcactatttcgatctggaacaggagatcaaaccggctctggagcacggcgattttaagctgtaccttcagccaaaagtggatttaaaaaccggagaggtaacaaaggctgaggcgctggtccgctggatcgatcccgtaaaggggatgataccggtcagcgagtttcttccggctcttgtggagaacggactgattgagaatgtggatctctatttgtttggcattgtatgcagcacagtggagcgctggcgtcagcagtatggaaaagaaatttctatcagtgtaaatctcaatgaatgcgcttttaattacgagttcttttttaacgattataaagaggtttatgagcgtaatccctgccggaaggactgtatcgaattcgagcttctggaaagtattattttaaatcaggtggagcaggtaaaccgggttgtcaatgatatcactcaatttggctttacgtgctccgtggacgattttggaagcggctattcttcctacagcgtactgactaatccactgatcaccacgctgaagatcgaccgttccctgttccgtaacgagaatgaccttcgcgaaaagacgctgatccgctacatcatccagaccgctaaggaactgaacatgacgactgtagcagagggaattgaaacgaaggaatacgtggactttttaaaagaactgggctgtgactacgtgcagggattttattactataaacccatgtcagtcgaggattttgaagagctttttgtgaagaatcctatcacatcggcgtgacacacggagaattcgcagaagcgttaaaaatagtaactgcgtacggattaagtaaggacagcgggcggctttgaaagatcaaagccgcccgctgttctcatttattccgtctctctcgccgccagatgatcggcggcaatgcagaggtaatagctcaaaccggtctgctgcccttccagcatactgcggtgaaaatcgtctgtaagaaaaaaacgggactgagcggcgaaccctgctgcatcaatctccatagttcttctcaaacaggcaatatgcttctgtattgcagacagcaccgtttcatcctgggcacttagcccgtctttcagcgatctggccataaaagccataaattgtgctgcttcctccgcgttttcattcataacagcagcgtcaaccgcctccgcgtcgatagagtatccatactctttctgtaaatactcgttctggtccttaagggcctctccccactcttctttattcagaccggcaaacattttttctgtcttcataggaactccttagtctaaagtcttaccttaggttggagtcaagtatattttaaaaattttacaaaaaaagtcaggaaaccggttatccgtaaatcgatttcctgacattcactgttgggaccattaatctctgacttttgtaataaatcctgtcagattcatgcatttactgttatacgcctccatgaccagcttcttggccctctcttcactcaggttctcaatataataggtatggcggctgtcaataatggtaagctctccttcctgcccaatcaattcctgggcttccgtaacgatcaacttgtcatcaagatcaaatactaccttcattttgctcacctccgtatagtcctattataactccttttttgatggattgcaattttatgtacggtatgttttgtacaatccatcggcgtccttatgcttagacactgacaaaatagtaaaactctatcgcctccgcggatacccccatatatgggttatccagtttttgcctgactctccggaccacctctaataatgcgctgtaaaattgctcctctgtctcagcccccagaggatccttgagtgatacaaagctggcacttaatccgcctaaatcacagtttcgtattttaccgcatatgaaatacgatatgtccagcctcgcgcttatgtatattccgctttccagataaacagcatctgcttccttctcccaaatctctgacaatctgttttcggaaaacaattcctgatccaagcctgcaaaaatgatgttgtaccgtttcgtcttcatacagttccacactttttaaacattatattagtgtctatgtcctttcattcccggatcaattccataattacggaaagctccggccccgggcatcacaaaacccgccctaacgcggcccgcagcatattcatatcaatcggctttgccacatgtgcgttcatcccggcctccaatgccgcctggacatcttctgcaaatgcattggccgtcatggctatgatcggaatttccttcgcatctgcgcggtccaggctgcggataacgcgggctgcttcatatccattcataccaggcatctggatatccatgagtatgacatcataagtccccggttccgcggacgtaaatgcctccaccgtcctggccccatcttcccgcagatcggaggacgccccttccatatggaggagctcacagaggatttccgcgttgatttcattatcctcggcaactaaaaaatggcgtccatgaaagatacctgccattttcggatcggcgtcttccccgctgtccttatgcgcagccaaggtttgttctgcctcttcaaactccagttctacaataaacctggttccctgattgattccgctttctacggagatggtccctcccatcaaatcaaccagccttttggcaatgctcaatcccaaaccggttccttcgatacgttctgccgcctgttctctggtgaaaggttcaaatatatgcttcagaaactcttcactcattccaattcccgtatcctgcacggtaaaacggtaccggacagttgacggtgtatgttccgttacaatctcttccacccgaaaatccactctgccgcctgcaggtgtaaacttaaccgcattccccagcagattaatcagaatctggttgattctcaggaaatcaccgtaaaaaacagtacgggtaacctgttctgcgcatatggacagctgcacgccctgctccctggcctggggaaccaggatggctgtcagctggtccacgaggtcgggaagctggagccttatgtgattgaacgatattttcgactgctcaatccggctcatatccagcacatcattcaccagactcaataaatgcctgctggatacggtgatcttctgcagacagtcttccagccggacccggtcatcgatatgggcgaaagccagggttgtcatgcccacaattgcgttcatcggagtgcggatatcatggctcatggcggataagaaattactctttgcctcgttggcctcctccgcatccgccagcgcatgctccagttccttctttacctcgcgctctgccgctatcatgtccgtgacgtcagcccggaccacacagacggtatcgtggttccggtttccccaaagcatgctgaactgcttataccgaatcccctccttccccacacaggcagcaacaaaatcatagcctgaaggttcttgctccagccgctgaagaatcgtttccagcctgaattgattttgcacattctcagcggattcagacgcaatatcgtgatcggtaaacgttctgacagcctccgcataatcttctgtggtatccggcggcagattttccagtaccatattccgggtatacacggtgacgctcccgctgccgacatctaaaagccccataagttcaaacgtatatgccatcatatgcagcagcccctgctgctcccgcaccgaatccgtgatatccgtacacaccatacagtagcgttctaaaagaggttcaatggaggcaatcgtcatattttttatgcggatatctccatgattttccgtggaaaaggtaaacgtataggggcccttttttaagcttctgcgtatctcatccgcttccagcgcatggcggaactgtctgctgtcctttggcagtacgatggaatcagccatctctgccgtctgtctcgaatgacagccatggagagcagggatgtaggacgcattctcattgcaggccagtatcgcataggaatcatgaagaaggtccacatcgaccacaaagtcatggctcgtgaccgacagctgatggaaaatccgttcagagatcgtttcctccgtaatgtcagtaaccgtaaggattccaatgatctcacctgcttccggacctgtcaggagattgaccttgaactggacaaagcggccgtatttttcctcgggaagacggataaagcagctcatcgcctgttccgttttattctgggcatatgcgtccagcatagattcattcataaatattttcaaaaatgccttttgatcttccctgtctgtaatcagccccgcgagtccctgaaaaaatgcgtccctgcgcctcccaaaccgttccacaagtgcggaatctgtggagtcccgcatttccaccacccggtcccgggaaatgctgctgtgcccgagaatcagttcattggccccgttcttatgataatgctccagaagctgctcctcgtaccggcgccgcagttgttcctgctcctcgatcgtcttggtaatatcggtatacacaatatatatccggcggatctcatccggggaaggcagcatggacagcgtactgcacgtccagagatagctcccgtcctttcgctgcatacgccccgtcagctcacaggttcctgttccgcgcttcaaaaattcctgaaacttctgccgattcttttcagcgtcctccggatgcatccccgcaaagatatccgcatcatacaagtgtccggcctcctccacggtccgctgtgtcatcgcagcaaggcccggtgagatgaactccgtcctcatcgttccatcccgatgatacgtcatcatggaaataccgccggggaattgttctacgatgctccggaagtagagatcgagacgctctttttccctccggatctgaaccgcttccgtgacatcccttacgtattttacgtaagcaggaatgccgttccagtccgtctcacgggaacgcgtatacgtaatccgctcggttccgtcctcttttatctcatactcttcgccgtccagcctgcccgccataatgccgcagaattcgcaggctgcttttttgttatgcagcgcagcgtaacatttttccccaagacagtcaggcccgggggaaaagatgccgccggtttcattgacatagagcagctcaaaggtatccctggcgatgacatagatgctgtccgccgtctcgttggtaatattctgatataagcggctttccgacgacattcccgtgaagactgcgtagaacatggctgcttcggaggaggttttgatctgccgtccatttaagtgaatccagatgagacggccgtttttatggcgcatccggtaagatacgtccagaacctccccgccttccagtgcttttgcagccgccgacaggccccgttcccggtccgcttcatagatggcgcccaatgcatcgtttttcaccatctcattgtactcttccctggtgtggccggagatttccatcacgccgtcggaataatagacagggataaaacggccctctcttatctcatagcttgcaatccctccgggaatggagtttacaaggtgttctaattcctgttccagcagtttttgtttgctgatatcggaaatatattcaatatgtgccgggcggccggaccagtcaatatcctttccgacataccggtaggtatggccgttccccggattaaagagctcgcggagtgcgctgtcctcctgcccgagcgtcccggccggacaggtcggacaggggctgtcatggccgaacgcctgataacaggtcagcttccgtcccaggcattccggagcaattccggaacgcgcggccttattggcataaagaagctcccggttatccagagcactgatgatcactgtcgttggtgaattgtccaggatcgcctctagctggtccatggagatcgatgtatcttttgtcattgctggaatcctcctctcacgccgttccggctgaatccctgcaggcttgagtttttgctgtgttcacattcataataatacgtccagtatagcaaattcctcatcgaatagcaatgttttacgaggattcacaatccatttccccctcagtcctgcctgtttcttatggcaaagcggccgcagtcatgttatactggttacaatatcctaaatagtaaaaatgaggtgaatacgtgaaaaatgatatggaaaggtgtcatgtcgtctatgatgttctgaagacccatattcaatttggcgcctatcgttttggcgatgtgctccctacgatggaaaacaacactgaaaacttccttgtatcactcgatactatacgcagtgcttatctccagctggaacgggagggatatataaccctttctcaaaatgtagggtctacggtaataaaaaattacagcgaacaggaaatagaacagaatgtccagcttttcttttcccttagaaagagcgcgctcatcgatttaagcagatctctgcgcccgctcttcaccaatgcccagtggattggcttaaagaatgccccttcggaaatctacaacaacatgctggaactcaggaaggatcatggcctgcagccttttatcgcatttaatcatatgatgcaggcatacgattctctgggcaacgacctccttacccggctgctctggcaggtctatatgttttttgaagccccttatttatgtgtacccgacaatccatggtgtgatttcgctgtccaggaatttgctccgcagtccttggacctttgtcttaagcaggactgggattctcttcagaaattaatatgccaggcacaggatttcctttccgtgtccttatgccggttttataaggaacggatcacgctgcagtcacaggaggagatcccttttacatggaattcctataaaaaagcatcacagatatgctactctcttgccatggacttactgattgacatcagcctcggccgctatccggtcgatacactgctgccgtccttgaacaagctgtccagagagagaaaggtttccgtgagcacagcgcgccgtactctctctttgttaaacggtgttggcgcggtaaagtcaatcaagcggattggaaccagggttcttccttttcacgagacggccggtaactgtgattttaccaacccggtagtccgcaaacgcctcctggatatggcgcagagtctgcaaatcctgacactgtcctgcaaagcggtttccgagattacgatatcgtcactggatgccgccggaatacaggcaggcaccgagttcctgaccaccatggagacgcgccagatgtatcagctggtctcttatgactgcctggatctgctgcggaagtttgctccctatgaggcgatccgcacgatctacggggaactcctgaagcagctgttctgggggtatggtcttcgcagtatgtggaaagaagacgacgctccaacggattcttatatttcgtattataaagccttactgcaatcgctgaaagaaacggattccatccgcttttccaggaaactggaggaactcatggttcatgagtttcatcttacaattaccaaactggttcagctggggattgtcgaggcagaaggacttcttattccagacctgtaacagaaaccaccggaccttagaaaaaaggagagcgtgtcaggggcggcaaagccgtttcaatatccctgacacgctctcctttttttcatatcataccttgcctcttctgtcttcatttacggttgatctttacaatttcctttgttatacttatcctgagcacaattattctgtatatgagcaaagaagtcttttcagacgtttggaaaggaaaacatgattaaaataacaaaccaggccaatttaaagtttcaaatgatgtcagataacctccaggtagggatactgaaatgcagagttgacgaatatctttccatcgaagagatgaacgacggttttgttcagttgtcagggtacacggcagaggatatggaacattgttttaagaaccgtctgtcgtcgtgtatttacgaagaggatctatcggtatttcaagccctgcagacggggatcgcgcagggaaaaatatatgctacggcagaatttcgtattcctggaaaagacggggcagcccgctggtaccgtctgcttgtcctcacacaatttgatgatacgggaaagccctccagcgccatcgggattatcttcaacatagatgatgaaatgcaggcgatggacaggctgcgttctcaggcacagcaggattctctgaccgggttatacaaccgcaaagaaaccgaaaagcggataaaacagtttctggacagtaagccggcgcttcccagcgccctgtttatggttgacatggataacttcaaactgataaacgatacaaaggggcatatggtaggggatgtagtcctgacggaagcggcctccgccatgaaatctctgatgcgcgcaaccgatatcgtgggccggattggcggcgacgaatttattgtttttatgaaaaacatcccctccggagaggccgccgaaaagaaggcagaacgcctggcagacatgttccgccatatgtttgaacatgaaaaatactcggttcagatatcctgcagcatcggtgtggctgtctatccggaaggcggacgtgattttaaaacactgtacaggcatgccgatcaggccctgtaccacgctaagaccaacgggaaaaataaatatgtcatatataacgataagcagaactatcagcagggaaagccaggagactcttccatcggcgcacgcattgattccgaaacgagaacggctcagggactcggggactttctgactgatatttttaagattctttaccgcatggaaaatccagaccaggcgattaatctgattctggaaatcgtcggcaaaaaatttgatgtgagcagggcttacatatttgaatccaccgaagacggcaaatacacctccaatacttacgaatggtgccatgacggcatttctccgcagatcgatcttctgcagaatttaagttacagccagtttggggattaccacaccttattcgaggatcagtcgatcttctactgccgtgatattacggcgctgcacccggcacagagagagttattggaagaacaggggatctgttccacactgcagtgcgccttctggaaaggggaagcgcttgcaggcttcattggttttgacgaatgtacaggcctgcgcctctggacggaggaggaagtggatattctgtcgctgatcgcacagatgatgaccgtttttctgcagaaaagacgggcgatggactggtacagcgatatggagcatcagctgcatacgattctcgattcggacgattcctgcatttacgtcatcgatcaggattcctttgagttactgtacttaagtcaaaaagccaagaaattaaagcccaacgtacagctgggagaatcctgctatcaggcaatctttgggaaagacaacatctgtgatttctgcccgcttctaaatggaggatcgggattactgaagctccctgaatgcggcacgcaggcagccttacacgcgtctgccatgaaatggcttggtaatgacgcgtacctcttatccctgcgcacagattccgacgcaataactgctccggaagggaacacctccaccgttttgactgaaaaaaacctggcagactgtctccagtggctgacctcctccgtatatcaggaggatgccatagaatacgttctgcgtatcgttcagaattattaccagtctgaccgtgtgtacttaattgaggtagatgtaaaacacaataccgcaaacaatacctatgaaatctgcgcggaaggcgtagccccgcagaaagacatccttcaggatcttccgcttgaaacgatgtccttctggatggaacagtttgcagtcagaggctatatcaaaatcgataatgttgaagaactgggaaaagaccgccaattggaatacgacattctgaaaaagcaggggatcaacagccttatggcgatcccgctgtccgggcagggcggcttctgcggattcctgggtgtggatgaccccaaacagaataaaaagaatttccattatctgagagggctatcctattttctcgagagcgaactcgctaaaaatgcgctgaagaaaagcatggagttcatgatttatcaggattccatgacggggctcgaaaaccgtaacagtttcatggaatactgcggtgacttctcaaaacgtatgccggctcccacaggagtcctatacatggatatcaatggcctcaagcggctcaatgatacaaaaggccatctgtatggagacatgctgatcacccgggtatccgatcagatgaaacagaattttcccaatgcccggaaattccggctcagcggggatgaatttctgattgtatccgagggactgacctatgaagcatttatgatgcagatgaaccggctggaagaatccttatcagataatggcttctgtatcatctcaatcggcaccacctggaatgatatctataccgacttatacgaatcgttacataaggcagaccggctgatgtatctgcgaaaacaggagtattacaggaaattcctgacgattgcgcccgaaaaaatgcctatgctgctggatttgacaaacgcaattctgaataaagagtacctgatttatcttcagcctaagattaacttaaaatcaggacggatcgacagcgccgaagtattggtgcgttacagagaaacggatggttccatcatgccgccctatcagtttatccccatgcttgagagtgaggggctgatatcaaatattgatttctttgtcctggaagaggtatgcaggcttctgaccagctggaaaggaacggcgttctcagacatcaggctggcgatcaatttctcaaggattaccctgtttgacaatcactttttcgataaattccgggatatctttcagcgttacgagatcaaaccggaacagctggagatcgagattacagagacgcaggagacgctcaacaaaaagcagatggccctgctcctcgatcagctgaagagccacggattcggcatcgttcttgatgatttcggtgtcgaatactcctcctatgaatttttaatgatgacggactttgatctcctgaaaatagacaaaagtatcgtacagcggtacggaacagccggcaaatgtgagattttagtcaaacatatcgtggaaatgtgccatgagctgggcatcgaatgctgtgcggagggagtcgagacggaagaacaataccgtttctttaaggatattggctgtgattatatccagggatatctcatcggaaaacctgttccgccggaacaatttaagcggtaaccaaaaatgcacttctatattattatgtatgtgagcaaagaataatgaaattttaggacaggtgtaaacagtatggatttcaacgaaagaaagaaacaaagcaattcctgttcgccgcagacggcaggcggaacatgtccagaaaggaaatatccagcagggaaatgtccagaaggaatggatttcatgaaagtcagcgttatttgctgtttgatggatgaccctctcacattcttatgggggaactccagctttttccgccttacaggttatacaatggaagaatttttgagtctcttcccgagcctgcaggaatactatattcagtttcctgatgattttgcagcgatccgtcgtgaggcggagcaggcaatgaaagccggaagatctgatatcgatatgaccatccggctgccccggctgacagatggttattcctgggtgcgccttctggggtcagtaatcgctgatccggcggcagagggaccggtactccaaatggaattagccgatatcagtgctctggctgccgaaaaagaagaacaggcccggttgtgtgaacagaagcagcactgctttcgatcggtgctggatacctacgaaggcaatgcttatgtcagtgatatcgacacctatgagcttctttatctgaaccagacctcctgcgaggtgcttggcatgccggcctcaaaagtgttgggccaaaagtgctatgagatcattcagggccggacctccccctgtcccttctgtaccaacgacaaactatgcagggaagaattctatcaatgggaattctataatcccactttaggccggacatttatgatcagaaatctggaaattaactgggagggacgccgggcacgcctcgagctctcccatgacaccttcagcgcggaatacaagctggcaaagaaggatcaggagcgggacgcgctgattaacagtgttcacggcggatttgcgcgggtagacgccagagacaggaggacaatactctggtatggcggcgggttcctcgacctgatcggctatacgaagacagaatttgaacaggagctgcattcccaatgtacctatgtacatccggaggatattgaacagatctccgatatcatggagcagtcacggttcaccggcaggcccacggcggcagaaggacgtatcgtcacctttcatggggttcttaagatactggcgctgtccttcagctttgtcagtgccaaggacagctgggatggcatcccgtcctactacagtgtgggactcgatgtgaccagggaacgcatggagcaggcgcggcagagacaggtgctggaggatgcctgcaagacagcccagattgccaacgaggccaagactaacttcctctcctccatgtcccatgatatccgcacgccgatgaatgccatcatcggcatgtccgtcatcgcccaggcaaacttagactctccggaaaagacacaggattgccttacaaaaatcaacacagccagccgccatcttctgaatctgattaatgaggtgctggatatgtctaaaattgaaagcgggaagatcgatctgtcatcggaggaagtctcgctgccaaaattgattgaagatgtgatggatgtattccgtcccctggtcggggaaaaacatcagacgcttcaggtaaatgccaatcgtgtccgccatgaaaaggtggtgacagacggcggccgcctgcagcaggtgcttgtcaatcttctgtccaatgccatcaaatatacgccggaaggcggaaccatcggactgcgaatccaggaaacgccctcttttgcaaagggaaagggacagtattccttcatcgtaaccgactcgggaatcggtatgcatgaggactttatcccgcatctctttgagcccttcacccgggcagacgacgccagcattcacaatatccagggcaccggcctcggcatggcaattacccagaacatcgtccgcatgatgaatggcaccattgaggtaaaaagtactccggggaaaggcagccagtttatcgttgccgttacctttgatttatgcggagagccagagacagatgatgcagaactggccgggctgccggttttggtcgtggatgatgatcagatcctgtgcgaaagcgtttccgaaattctgaacgatctgggtatgcagtgcagctgggtactgtccggaagggaagccgtcgaccgtgtcgccgcggctcatgaagcggcggcggatttctttgctgtaatcctggactggatcatgcccgatatcgacggtctggagaccttaaaacgaatacgaaaaaaggttggcatcgacatgccgattatcatcgtatccgcctatgacttctctgaaatcgaggataaattccgtctggcgggcgcagatgccttcatcacaaagccgctgtttaaatcaaaaatggtacataccttccataaattttgcagaattgaccgttccgacgcccggagcgccctgcgcgagagatcagataccgccttggacggtaagaagctcctgctggcagaggacaatgaactcaatcgtgaaatcgcagtcgaactgctggaaacgcacggcctcctgatcgatacggcggaaaatggttccatcgcagtcaacaaatttgaagcctccgctcccggagagtatgccggtattctgatggatatacaaatgccagtgatggatggatacaaggcaacgaaaatgatccggtcactggaacgggaggatgcccgcaccattccaattcttgccctgacggccaatgcattcgcctccgacatcggaaaggctcacagcgcgggaatgaacgaccatattgccaagcccatcgatatcgaaattcttatggaaattctgcggcggtggattggttagacggaatagtggatcatttaacagaccacataacccggccacataataggacacataacaaccggtggacagatatggcgaaaatcgccagttctgcccaccacatctttcaccagaattttttacaaaacagatatctaagcctctgtaccagaaagacttttacttcatctaagagtaatacgatcctgccaatacgaacatcccggttttcactctgccgcaagaggaatcatcatcatcagaaataatatttttccgaatcgtcaatacctctctacaagtactcttccgtcaaaagcccggctataacggaattgcctgctgcaatatcgcttaccatatcattgcccgcctgggccccgttaaaagctaaaacacttccgccggcttcccgcaccagaagcatccctgccgcaacgtcccatatttttaagtttcgttcaaaataaccgtctaatcgtccgcacgcaacatacgcaaggtccatggccgcggatccgcttcttcggatatcctgacaatccataaacaggcgcttgaatatatcaaagttcttatccgcggtctctttgtaatacggggaagtccctatggcgatcagactatcctccatacgcgccgcgcggcttaccgctgtactctttccattgagccggcagccccggcccttctgtgccataaacagctcctcactgtatggattgtatacaaagccaagcactacctcactgcgctccatcagtgccagtgaaatgcagctggcatggcagtcatgaatcaaattggtggttccatccacaggatcgaggatccacacaaggccggatttgtctatctcctgattcgtcttttcctcactcaaaaattgaacctggggataatccgcttccaaacgcccgcgtataaactgctgcaccctgtaatctacctcggttacgtaatccgcctctccttttatcttcacacagccagcggcttccctatcctgaaacagttcccccgcctgccgaagaagtgcttccagtttctcaatattaacttttgccagttccatccgtaatacacctttcctgattatatgctgcatacagccttccatcccgcattacccgaaatactgctgctgtgtgcggttctattttatccgcaaatggggccaccgtcggacaatcgctgtaataaaccggtatgccggatttgtaaagcggctctaaaactgacggagccgcactctcatagcgcctgtcactggaagcgcagatcacggcatactggggcgataccgcctgcagtatttccggagtcaggctattggcctgaccatgatgccccaccttaaatacgtctgcctttatatcccccctgcatgcttcgtagtcagatgcctccgcatcgccagccagcaaaaatgttttttcgccgcaggcaatatgcagaatcatactggagctgttcatgcatctgtcaagagccggcagcagatcccgtcttccttcctggtataaggcttttagccgcgccgtctgccggtccagagcctcttctgccggcccaagaatatgaatccggattccctttgccgggaacatggtgctgctgtccggataacctggtttcgcctgaataacacggcctccctgcgctttcacataacggcataaagcggcgtagccgttcagagcagcaattagcttacggccggattcctctccagtcccgtcattgagaagcttcatgatttctgataactcagcgggaaaaggctgccacagaaattcaggacaccatttcaaagcaatcggaagcagaccgcatgtatggtcttcatgaatatgcgtacataccattacgtcgatatgcttaatgcctcttttctccatataatcgactgctcttaacctgcctgttgtccgatccgcatactctgcctgctctccgcttccaccgtcaatgaccattacaaacatgccgtcgcggcgctccggatccggcgcttcgatcagaattgcatccccatttcccacattcataaaagtgacttgcgctgtccattcttccattttatttcatcgcctttttcatataaatactgctcataatcaacacaaatacggtcataactatggcacaggcactggctaaaccgaatttcaggctttttataccgtatgtatacatgaactgtgtaatagtagtggtcgtgttagccgggcctccgcccgtcagaatatttaccttttcaaacagccggaacgtatcaatcgtacgaagcatggcacacagcgcaatcccaccgccaatgttgggaagcgtaatatggcgaaagcgctgcaatgctcccgctccatcgatactggccgcctgatactggctttccggcacgccctgtaaatgggcatagatcagcaaaaaggcaaatggaacattctgccagacatcaatcaccaacagcgtaccaaaagcagtctttccatcataaaaccagttatataccggaagtccaagtgcggtaaatacatcggttataattccataattcggcgacagcatcatacgccagatcagcgcgacggtgacggccggaagcaggtagggaagcagaagaagggttctgaccaccttctgcccccgctttagacttttgacaaagagagccgtcagaagtcccagcaccacctccagtaccaccgcaatcactgtaaatttcaccgtatttgacactgcctgccggaaatacatgttctgaaacagtgcggtataattggcaaggccggaaaacgggtgcgtcccctttaaatagttataatctgtaaagctgtaatatattgtaaatagtaccggatataccgtcataaccagcaggaaaacaatcgttggcgccgtcatctgactgacgaagattcctttttccctctttccaaattcccgtctgaccatctatgtattaccatgcctttccataattctaattttgtacggtttactgcattaacagctccaactgtgcctgtgcatccgccagaccctgttccgtcgtcttgacgcctgccataatgcttcccatttcagcgcccagaatgttcgtaaattctgtccactcagcgatggccgggcgatagactccactctccagtgctttgcatacggtttccaggtgtgggtattcattcagtatctcttcattggtgaggcagctatatctgcatggtacccctccgtttgcaatactctccaactgtacctgaggatccatgatatactgaagcagttcatatgcaagatccggatgggggctgtttgccggaatcccgattgtccatgtgccatactccgaggtattgtatacctggccatccttcgatgcctttgcagggctgaccatgtaattggccgcactgtccgcgcttggcacataccagccaggccagccgatcgcaagtgctgcggaaccattatctacggctgctgtcacatcatccttggacattgcggcgccggttttaatcagttctgtatagtaattcacagcttctgtaaattctgctgtatttaccgatggcttattgttatcatcgactacccagccgccgtatgccagcaggatcggcagaaaatcagatacaatattatctccggtatctcctctgtaggcaaaaccattaataccggattccttcgacgctttcgctacagcaagcatgtcctctaaagtagtaatttcctccggcttgtagcctgccgcctccacatttgccttattgtaaagcataaccgtcacattgccaaaatacggcgccaggtagatatcatctcctaccatacagattctggtagtgttgggaataatatcatcatcaaactggtatcccatctctgataaattagccagtacattgttttccgtaaattctgccatccagcttccatctaccatacataaatcgtaagttcccgtttcattgaccgcatccagtgcgattcccgtatgtaagtcgtcaaacgacatttccaggacctcaatcttacagttatgatccgcctcgaaatccgggagcgcctttttaatgacctctgcataggaaccgcctcttaatataagcgtcatctctgctgtttctcccggagccgcctcctgcgcctggctgttctcagtctgcatggcgctgttcgcctgtgtctccgtgctgctgtctgctgactgcacagtctcccgggcgctgcttccacacgcggtcagcgaggccgtcatcgcgaggcccgcagccagaagtttcaaatttttcattttcatctttttcattttcatcttcatctttttcatctccattttctccatttcctttcatgctcacttttctttactctattctttcacagccccacttgataatccgcttatgaggtaattctgtgcaaagatcacaaagactgccaccggtataaacgagcttacgccccctgctgccaccaatccaaagtttgtaacattatcttctgtattcagcaccgccagggccaaaggaatcgtataattggatggggagcgtgtcagaatcacgctgtatgtatattcattccatgcatacagaaaggaaagcatggcaatcgccgcaatccccggcaaaaccagaggcagtacaagtctggtgaaaagctgccactctgttgcaccgtcgatcttaccgctctcttccacttcctccggcaattcctcaaagaaggacaccataaaccagataaccagagggatattaaccagcatgcacgccaagattatcggaagtctcgtccccatcacccccatcctggtaaacagggtatacagcggaatgacaaatgctaccggcggcagcactctgatcagcagcacccacccggttacaggcagcctcagacgaaaccggaagcgtttacgcgacaatacgtaggctgtggtaagccccagcgccagagacagcacaagcgcagtgcccgcattgatcaggctgttttgaagggcagtaccaaatgacttctgagtaaacagttctgtaaaatgggaaatggtaagctgttgaggaaatagtcccgctcccgcactggtttccgccgtcggacggattgccatgattatcagccaatagatcggaaacagtgtgacaaacagtaagacggacaaaccgattcccttccataaaaatatgcatttttttctcataagccctctgttcacccggcttatatcccgttcagccgctgcttttgttcttaccggcagcgcacgctctgtcatttccatgttgaatacctctctttctacatctttcttctgagatgaagattcataatatctgttctgatataatcataggaaaacaggacagggattccttcatcatttacatgcagctgttcaagaagcactaccggctcttttagatacacaagcgccagctcgtcccatgcgttattgggattaactcctttaatgaaggtatccgcaccggcaattgtaacaccgcatttatctctcaataactgaaagatactgccctttaacccctcatcgaagatatcacccaccagcttctccggaaatatattataggaaaatacaaccggcaccccattggccgttctctctcggttcatcacaacgatccgatcctgctgtgacagccccagccgctccgaaaccaccagatccggcgtttcatgggtgacgctgtagaatatacttcccgcttcatatcccgcattttcaatcatctgcccgatggagcttaaaaacatgattggattctccatcttctgcttgttctcttttacataagttcctgaaccgtgacgcttgtccaccattcccttttgctgcagaatattcagggtttcccttatggtggatcgacccacatggaattctcctgcaagcgctaactcccctggtatcttctggccgatctgccattctccgtttcttatcttgttttccagaattcctgctatctgttcataacggtactgcatcctgtactctcctgttttcgttttatgtctcgcaatagttgtcagacatcttttatatttttaattatagagagaggaagtaaaatctgtaatcatctttacgtaaactgttagtaaaaccgggcatgtactgccaaagtaagcaaaatcgagtataatcaggcgagaggaactaatcaaagacagccagtgatattctgatctttatcatcagcttatcactggccggaagtattttatatggaattgtatcaaggataaacttactaattaaagaccaggagcatcgccagggaattgcagaatattacgcagttcatccgccgctgcgaatccactccacccataccgaataatattttcccagaatatgtgcgccatcagtggagtaagccacagacaaatttccgttctcatcgtcaaagaggctgttgacatcgatgtaacgacagccggtatcttccgctatatttttaatagatttatttagggcgtcaattctctggttattaaaaatattgcttttggcggctttttcctctgttacgtgtaaattggcctcaagcaccagggctgccgcaggctgctctgcgcggattctctccacgacagagcggtattgattgacaatcgccttatcttcatatccaagctcgttaatacccagcatgagataaatcgttcgatagttttccgacgcgaacacttcctccagcgtctttttctcgccgcctttcacggatacccgagcctcaaagagatcaaataccgacataccggaattcgcaaatacatccgcctgccctaaatcaccatactcggaaagccccacagtccgtgaatctcctataaacaacacgctggaaaaatcttcattaatatcactctcacttacagccgtttctcctgtctccggagatgatggtgtactctcctctgcgttcattacttccatcttttccgtctcttccgcttccaccgtcacggacgccgtcatttctgcgctctgtgcctccaccatacggttgtccgcaagtattgccgccgtctcccgggctatcggttcgtttttcggtatatccattgacagtttcgtggcggccatgacaatcatactgcctgtcaaaagaatactgtaccaatatcttctcatcccacacctccgccttcaatcataattctaaaatctgaaatataaaaacggatcgtccattccaatacgtatacaatacacacaagcccagaatacggccagaagcacaactgccgtaaccagggagtatttatgccgattataaattcgacaggggatatccgtcataaacacaagcccagccgcaatggagaccgcgtaaagttttccatacttcagataatccccgctgaaatagaaatggctctgtttcattaaaaaggggaacagtctctgaaaatacagcaggatctgtctgatgtccgtaacggcaaacacaagccaggtcaaaggaatcgtaagcatcatatagagatgtccgattacccgccgccgttccagcacccgaagcagtccaattcgctcgatggacatgatcaggaacagcagaagcccccatattataaagttccagctggctccgtgccagaatccggtcaaaagccagactgccagcagattccgaaaggtcaaaagggcccctctccggttccctcccaggggaatgtatacgtactcccgaaaccagctgccaagagttatatgccaccttcgccagaattccgtcatggacagagacatgtatggatgattgaagttattcggaagcttaaaccccatcatagtacccagtccctttgccatgagtgaatacccgcaaaaatcaaaataaatctgcaggctgaaggctgcaagaccgagccaggccaacggggtggaaatgctctcataaccaatcgtctgcacttcagtccataagccgccgacccgatttgccaggagcaccttaaagcccaaaccaatggtgaactccctcagcccatcctcaatggcgcggaaggtaaccttccttctgccaatctgtgcccgcatagaggaatacgtcacaatcggacctgcgatcagctgcgggaacatgctgatatacatgccgaagccaaccatagaccgctcatagggaaccgtttttcgatatacatccgccagatatgaaactgcctgaaaagtatagaaactgattcccaccgggagtaccggcgcaaaaaccggcaaatgcaatggaatccccgctcttcccagaagcagatttacgttttgggcgatgaatgcggaatatttgaaaaggatcagccaggaaaggttatagattataccgcagaccagccacctctttcgcatcctccccagcctccgccgtcctatcaaaatcccgattctgtagttgaccagaatagaaaggaccagaagaacaaaataaaaaggggtatccctgaccccataaaaataaaaaccaaggcttcccgcaaaaagccaaaaattcttccagctgcatgggattatgtagtagatcatcaaaaatagcggaagaaaccgaaatataaattctaaactgctgaataccatgttttccctctcatttgtaaattcctgcttcttttttagacaaataatgagggcaaaaagttgcaaatatcgagtctttttagaaaaaaattaaagatacatacgataaacagataagagatattacgaaattaaaatattagaaggataacaaagacaagcaccccggcaagatagctgctgctgtgccagcggaatcgtgcactgtcggccaacgaagtctccctcacagccagctggatttccagaggcttcgggagacttccggccggtccattttcagaatgttcgctcaaactgcaccatccaaatcctttgcagcatttaccaccgtcacctgaagattttcattaaacaggtttctccagtcacacttcccccatatgcagcttactatcctccaatttacaatacatcgacatcccgctcgccagtatctgcaggctgatggccactgtacgaatcggactgaaaaatgagagcgcccgattgataatggagaagcttgccagtccgatactccccagatatgccccgaccagacgtgagaccagtccgtttccaattatggagaaccagccgagggcacctccaaacagaataactacaagcacctcactcgcaatggaattcccgcctttcttcaactgccctgccaaaatgaccgtcaaaattccatggatcaccagatacacggcgctgccagccaaaagatacggcacagggaacacggttccctcaaaatccggcgccatggacaacgccataatctgcctctggcccatagccacgatcccctctaacaaaaaatgtcccacatgaattcccaaagagatccacatcagcttaataatactctcacgtttcatctatcttcctccaatcgccaaatactcccagttccccgtaaccccgtcagacatttctcatttttttcgttcgtttctatgatctcccccattttcaaatactcttgtaaacccgttatttttaaactcatataccagatagctgtgataaccgattcccatagtcgaaatcagcagttccttcgtcccatcgccgtttaagtcaaaaaagccttcgattttcaaatgatccgcggcagccgtcggctcggtaatcggaattataaatgatctaacttccccctccatcaccttccgcatataaaggacaccttccgaattctcgatcatatctgcatcatggtatgcctggacaaatacttcgtcctgtccgtccccctccaaatcaattttagtaacatccgttaatcggaattcttctttcacaccgatccccgccagatactccttcagtacctgacggtatctttcattttcaggagtaattttactgccgctcaaaatctccatatcttcttctcctgaaaatgccacgatactgtgatacttatcgctcgtatactcgaaatccgggaaatgcacctccgggccggaatataattccgcactgtgttccatctccttctgtccagatgcagtcccctgataatggccgtctatgtacattttataatcattcgtttccgccatcatgggataaagctccggccattcgatccatctgccatcgcaatatccgccaagaagaaggttgttgactgccaggatacgatattcggagaattggggagctttgtattcaggaactgctcccgcatttcccatgaaccaatcggaggtccgaatcggtactgcacaggaaaatatcgacagcagggtaagaaacagcactatttttcccatatatgatcacctccggaaaaagaactcagcggcatccggtaaatccaacggatttttttctggatacggcgaagggtaaatgtctgcctgctcatagaaagctttcgggtcagtggtcaccagataaacgggcttatgcagttcaagttccgacagcacatacagcggaactgtgagtccctccaggatcttcccctcctctgtcatcaaatccacacaggcgctgattctgaaatcttcttttccaacgcaggctgttctcctgcaatacagggatcttttctgaaattcctgatggctctgaaccagggaacaaagatagtaaccgtacccgcccaggaaaagtacactccagatgaccgtccctgcgatatagctgcctggatcgaccgatccctgtgtctcctgaacctccgtgtctccgttcatatttttctgatttaacaatgcggtcataaatatattttcatatcttcggttcctatactgctcttccgccgtcagatagagggacagaataaggcatgccccgaagccatacaaaaatagtcccaatacgatcctgtacgccagttttttgtgaaaataacgtttttcgtattttctgaaaaccactgtttccttagcagctgctgcatcccatctttttctccgctccatccattcctccatccatctccaacaggcagacgcttctttaaagtgttattcttcatataggagccgctgttcccggtacaccgcacctgaataaatgtaagttcccttcttattccttactgcaattatatgctatttccagttatttttaaatacagagttccatatttgtggtatatggcataagaatttattgtcggcactccaacgcctctgtccttcattcatgaggcaatttaaggggaagtatttcctctatcttcaactgcaaaaacaaagagtccggcaaaccggacttgcgcgccggagcgcggtcgcttcagcggccatattaccatagcgcgtagtatgcagcccccggggatatttcataagatgaaccttcctgtgaaattgtgaaataaaaaagaccaggagaaaacgctcacccgatctttttcaaacaccttcctttttccggttaccgatgcaaaaacctaaatcccattcgaccgaattaccttctgataccagtaaaagctgtctttttttattcttctcatatctttcaaatcactttcatccctgtctacatacacaaacccataccgctttccatatccctgatgtgtactgactaagtccagaaaagaccacgggcagtaaccaatcaagtccacgccatcagttatagccatctgtgcctgttcaaaatggcgcttcaaataatcgatccgatatggatcatgtacgctgccatcctcgctcagcaaatcccgggctcccagcccattctcggtgattaagagcggcagatgatatctgtcatagatgcgccggagtgtgacacgcaggccgatggaatctacgatccagccatattccgttttctccagataccggttctggcccgcacggtagacgccttcctcaccgatcatgacctgctggtcgccgccacgcggctggcagtccgttccatcattccggcttgcgctcacggtggctgtggcatagtaattgacgccgagataatccggctttgccttttcaagtagctccatatcccccggttccatcactggtgcatatcccttttcctccagataagaccacgccagggagttgtatcttccataaaccgccatatccagataaagccagcagcggatactttcccagtcatcggcagcaatcacatccgccggggcacacgtctccggatatatggccgtgatatttggcgccgggccaattttgccatctttacacaactggtgacagagtatgactgcctttgccccggctaagaacatgtgatggcactgttgatacagttcctttttcgagggaatcgttccggggttcatggcgtttggatggttgatcatcacattctgctcatttatggtcagccagtatttcacccggtcaccgaagttctcaaacaatactctcgcataccgttcaaacgcatcgaccgtgttccggctgctccaaccgcctttctcatgcagtttaagcggcagatcaaaatgatacatcgttacaatcgggacaatcctgttggaaatcaattcatcaatcagatcattatagaatgcaatgcctgccgtattgaccttaccgtctccatccggaataatccttgtccatgcgatggagaatcggtatgccttcagccccatctccgccatcagcttaacatcttccgtccggtggtggtaatggtcacttgccactttaaaatcggtaatcccttccggagtctcatagatatcctgaacggacaggcccttaccatcttcgtcgtaagccccttcgacctgatatgcagacgtagaagctccccacaaaaagtcatccggaaattctctcaaggttttataaaacatcatttagcccccttcttatttcatcaaagtcatcaaatgaccgctgccgtctgtggatttatgactctctgcttctatctttttatagttaaaactgttggtcacgattaccatggtctgcgtcttatatcccgcggcttttatggcatcgagatcgaacttaatcagcacatcgcctgccttcacatggctttcctgcgccgtaaatgcctcaaagtatctgccttccagctgaacggtgtcaattcctatatgtaccataatctccgcaccactgtcggaaacgaggccgattgcatgatttgttggaaaaagggcggctactgttgcgtcaaacggtgctctcaccaccccctcctccggctcaatgaccacgccctgccccaatgcgccggaggcaaatgcctcgtcctcagcttctgataacggcattacccagccttttaccggagatccaaactgaaatacccgcgtatctgttgctgtatcttctgctgttgtatttgcttctatattttccgctgcattttcttctgtttttcctatcacatctctgtctgaactttcttccttctcgaacttgaagctcaacagtaaggttatcacagcggtacttacgactgagatgagaatggcaatgatgatatttacgaaaaacttggtcgtatcgtcccccagatacagcaggaccgccggtaatccggaggagccggtggcaaatcggtgggtgtgggtcagccctgcataaagtccgcccaggcctccgccgatcatggctgccgccaatggatattttttcggcagggagacaccgtaaagagccggttctgtaattcccatataagcggtaattgcaccggataccgcaatctgctttgtctttttattccttgtcctcagggcgacgacggttgtggcggtcgcctgcgccatattggagcacacacagcccggcccgaaaatgctgtcgtatccgaggttagccatctgcataacgcccagcggcgctacaccgttatgaagaccgaacattaccatcaccgggagtgcagaacctactaaaactgccggcgcccatgcagccgattcgcttaaaaaagtaaaaaactgtcccagataattaccaagaactgcaccaatggggcctaatacagagaatgccagagtccccataatgaggaaggtaagcattggtacgaagaccagctccacggcctttggaatccacttcttcagccttttttctacaaaagactgtacaaagataatgagaatgatcggaataactgaggaaccgtaattcgccagagtaaatgggattacgtaaaaaaaatacaccgcttcctttgccgccaccagcgctgtccagttcgggtgaagcatcatagctgcaacgccggctgccaggatcggattgcatttgagcttttgagcacaggtaaaagccaggatcatgggcagaaaataaaagacgccgtctgcaaataaattcaacaggtaatacgtctgggaactgctggatatcaccttcatgactacgagcaacgccaacagggcttttaccataccggcgccggataatgccggtatcaccggctgaaagactccggccacaaaatctatgatctttgtaaaagcattctgtttctccccggctgcttctgcatcctctttatccttgcggacgaccaccagtttttcgatctcctcaaacacatccgcaacatgggttccaatgactacctggtatacccctgcatttcggatcacctttgcgactccatcggtttcctccaaccttctgtcatccgccttcccttcatctgccagtttaaaccgcagacgcgtctgacagtggtagacgtcattgacattttcttttccgcctacgttctttacgatttccgctgctaacttctcatgctttctgctcatatgaaatactcccctctcattgtgaatggaccttttacctgtgctgtacgcatccggaaaagcgcttccgctcttcttaagcacagtaaaccacaaatcattttgccaatcaagcaaacagcaaataccaaaactaagttttatatattgcggcttttgttatgttttcatgaaactttctgaaacagaaaacattttttgtgcagaaataaaagaagccgtgacgaacgaagtcaaatataatcgtatcgcacagcccctttcaacaggccttacctgtcctgcatttctttcatcatcgtaactcgttcctgttccaataacctggaattttttatcttaaactcaagattttgcttgtactgagaggcaaagcagcaggaaaacaggacgtttaaaatataatttaaagattcctccgtcgcgtaatttgcgattttactataaaggcgctccctggatgacatggtaataatgcagtccagatttttccgcatataattatcgcccccgcttgtaattccgatgattggcacatgatttttcttgagaagcccgattcggtttaccggattctgcgtgacactgtttccggaataagagataatgagcgccagatcctgcgggcccagcgttgccgcctcgattcccgcctctccgctcttcgcaacagctgcacgctttccgattgtgagaagcttccgcttaaacagttctccgaggtatgtattgggactgctgctgaagatcacgatattttctgctccggccagataatccgcggcctttttcagcacctctttatccagcagatctgccgtctcacgaatactctccatctgcaattttttgatattttcagcgatcgtatcgataccatcctctttctgaaacggtatattaaaatcaactgtatttttatactttttctggtaattcacctcggcaatgtaatccttcataaattctttccagccatcataccccattgcctttgcaaaccggacaaccgtcgctttcgatgtaaacgtcttttctgcaatctcagtcacagtatactgatacagcttatcctgctcctgcagaataaactcccccaccgcatgacgggcatcggtgtatctcatcatggtttcttctattttttgaaataagaacataggcgcttcccccgtattttgcttatataactttaaaacatttccatttaccagccttaaaacgcacatagaagatgatcgcccgcaggagccagtccaggcacatggcacaggcaatacctatgactcccatctggaatacaattccgaacagcagggaaaaaataagccttcctccaattgtagaggcaatcgaaaccaccatggtaaacttcacatcaccggccgcgcggaggccgttgcccagcggccccgaaaacggaaatacaatcgagttaaaaacattatggatcaataccagcagaatcaccagccgtttcgtttcatctgccagaatataggctttcataagcaatggcgtcacggcaaaaatcatggcattccatatcagggaaagcagaagcgtgattttcagcagctttttaaaatagtactccgcctggccgctgtcgcctgcccccatacactggccgattacggttataaacacagggcccattgtcactccggcgagggcagccatggaccagatactctgcgcaattccattcgccgctatctgatacgttccaaacagcgcggcaacactgctgagggcgaccttcacaaactgaaaaatgccgttttctatcccgtttggaacggcgatgcctaagatccgcctcattaagtcccggttccactgtaggatccatcccaaccgatactgcacacgttcccttttacggaaacagagaccagtgattaccaccgcagaaaacattcgtgcggccagggaaggataagccacacctgccacgcctgcatataatacaaatacaccgataacattgccgatgacattgatgatattggatagcaccgaaatatacatggtggtactggtttttccaatgctcctgtaaaccgccgctccagcattgtaaaccgcaatggccggataagaataagcggagatccgtaaataggtcacacaggcctccatcacctccggctccacttttccaaacatcagcctcaggatctgcctgtgcagcattaatatgactacagccgcagcagcggagaacagcagggatacggtaaaaagctggctggccgattcccccgccggttccgtatcgtgtctgccgatgtactggctgataatcacagcgcctccggaagccagcgctgtgaaaaggtaaatgaagatggtattaaaagaatttaccagagaaacgccggataccgccgcctcccccgcataactgactacaaaggtatctgcaattcccaccagcatgacgagaagctgctccatgaacaggggcaggatcaattttttcaattctttatttgaaaataagtgtcctgccatcaaattttctggtctcctgcaaaatctactggttcacaccactcattgcccgcattttcccccgggacttccacagccagatgtgagaaccagctgtccggcgccgcaccatgccagtgttttacgcctgttggaatgttgaccacatcgcccggtaacagttcccgtacctccccgccccattcctggtaatatccacgccccgcgacacagataagtatctgcccgccgcccttatcggcacggtggatatgccagttattgcggcagcccggctcgaaggttacgttgaaaatacccacctggtctgcggaaacaggtgctaagtagctctggccggtgaaatattctgcaaagctgtcattcggctccccaattggaaatatcatgctgtccgcgtactcttctttggcgctggcggtcacctcaccagccgtccagacctccttcgccatgcggaatgccgcccacgccttgggccagcctgcataaaacgccgcatgtgtcaaaatctcggcgatctctgttttcgtgattccatttttcttcgcggtctctaaatgatatttaaatgaggaatcggtaagtccctgtgccattaacgctgtcacggtaaccagtgaacggtctctaagggaaagtttatcctccctggaccagacctccccaaaaagaacatcgtcatttaattctgcaaatttcggtgcaaacgtaccaagtgcctcccggcctgctgtctgttttactgccattatttcatttcctccttgaattattcgtggtcatttactgccattttagccgcttgctgtcatctcagccacctgctgtcatttcagctgtttgctgtcatttcagctgccttctgtcatttcagctgtcttctgtcatttcagctgtcttctgtcatttcagctgtcttctgtcatttcagctgtcttctgccattgcagctgccttctgtcatttcagctgccttctgtcatttcagccacctgcgtatctccggttccgcagatccggcgcttccgcctcggatcgccagaccttttttcagctttgcgccgggacaaaggcggcggatatccgcctcactgctgcccataccgctgccctcgtgggtgcaaaacggacaaatcgttttaccggtgaagtcaaaatgctccagaaatgtgaatactgccatcggcatcgtgctccagtaatttggaaagcccagataaattgtatcgtacttctcaaattcttccggataatgctttaactccggcctggcgtcccgcctctggtccacctgcgcctccgcgatgcattcgttgtaatccctggaatattcctgaactggctccagtttaaagagatcggctcctgtcaacctttgaataatgcctgcagcaatctccgtattgccaacttccaggtttttgagcatcccgttcacatagttttgatgctttcttgaaaaataagcaataagttctgccatattacctgcctcctttttaatttctgacttaattataaaacagtatttcttgacacggaatctccaatatgttactttggtattaacttatagtttatactctgtttaatccaggaggctgaccatgtttaatccccagctgaccgtctttgtatgtgttgccgactgcggcagctttacaaaagcggcagaagctctattcctctcaccgaccgctgttatgaaacagatcaatgcactggaaaagcatctgaatctgaagcttctactgcgcagtgcgcacggcgttcatctgactcccgccggagaagtcatctacagagatgcgcgttttctgttcgattattccaggcgttccatcgagcaggcaaggcaggccatggatgatgccgaccgcatgttctgtgtgggaacttcccttttaaatccggctaaaccgtttatggatctttggtacagggtcaatcgggccttccccaattacaaacttcacctggttccttttgaagacaatcacgaaggcatcctctccgagattgcacagcttggtaaaaaattcgattttctggttggagtctgcgactcgagactctggatggaaaaatgcagttttctccagcttggccgctacaaaaagatgtgtgccgtgtccagagagcatcccctggcctgcaaacagaatctggatatctctgacctttacggagagacgcttatgatggttgccgagggcgattccggcaccaatgactttatccggaatgacttaaatcggaatcacccggaaattcaaatcgaagatactccgcatttttacgatatctcggtctttaaccgctgcgccgaaacggaaaatgtgctgctctcactggaatgctggcaggacgtgcatccgggacttgtcaccataccggtaaactgggaatacagcattccttatgggcttctgtatcccttgaatccggaggacgatatcaggcggtttgtcgatgcggtgaaagaattgatttgacaaatcgcgtattctgtttaagaaataaagagtccggcaagccggactctcgcgtaagagcactttcctattacacaataaaatagctccagccgcgtaacgatggctggagctgttaattatttaaattgtttgccttactttttccggtgttatttccaaaacacgcgtaaggaaagagtacttttctttcatcatatcataatcagcgccttccgtgaggaatttggctgtaccgtctacgacaaatcctgttcccatccccattttcccctggacctcgtggctgcctaaggtgacgatcactttgttctgcacatcaacatttttttgtgttttgttaaaccaggcagctgggatcagtattctattgtctgcggtaagaaatagatagctgttccaggtattggcaacatgaaccttctcatttgcccaggatgttactgaaacaacgccctcatgattcagcacttctataaatgattcattaaacatataatcctccaattaagtatattatagataattgttatctgtaatagagactatatcacactgtttttaaaaagtcaattgatgcccgcaaaataatatgctataatagatatacattatctgtaaaggagtgattctatgcaattaagtcaaggggtcgagtacgctttccactcgcttttttatatggttgatatgccggttggttctacgatcggaatcaaagagcttgctgaactcaacaaattatccgaaacatatctctcgaaaatctttacaaaattacgaaaggcgggaattgtccgttccatccagggggcaaagggcgggtatgagcttgccaaacgagcacagaatatttcattttgggatatcgtcgaagcgatagaagggccgtcttatatgttccagtgcgcggaaatcagacaaaataatattttggcagatgaaaatgatgcctgtaactgcagcaaaccatgcctgattaaagttgttatgcaggaggcagaggatcagatgcggaattacctttccagcaaaaacctggcctggctaaaggaggaagtttataaagattttacggatacaaagaaacagtccatagaggagtggctgagcaaatccattaaatagatttgctcagccatcttttcaatggccattataagagcctgatgctttgaattgtctcaaatctgttatgtcagtgaccggtcagttttaataacagccacaggaaggttggaaagataaatgaaccccctgtaaccaacaacgaaatcttcccgtgcaatgtgaattcctaactgcctgaacttttaaacggctctccccctccggggattgaaccaggatacttcataatcacagcagataattattttcccgattcgcaacctgcaattcaaccaatttatatgttgcatatccaccggtaaccaagggctccctgctgcaaatatcttctgcctcctcacgactgtctgtttttagaatatacatacctgccatccccggataacctttaaacacgccgcaaatttccagctttccctcatcgtccagccttcttatgttctcaacatgctctgtgactgctttctttgtcagcttattataggtcctgctcttctcgatcatcatcacgtacattaatttttccatgctacacgctccttcatctattccaatttgccaattcggtataagaaccaaaaactcataaaactacgtttcacttgtactgccaatttcaagcagatttccctccggatcggcaacataaaagttgtggattccgaaggaaaaagtcatggggcctcccgttgggaatcttaaatccatcttcgataaccgctcatattccgcatctacatcggcaaaacaggggagccagagggcaatttcaaaagtctgatttattcccctgggcggaacgtagctctcaccaattgcctgcacgaatgccttcctgctatacataaataaggacagttcaccgcctgccgtcttaaactctgcaaaatccccaccatcccattccgtatgaaagcccaaagtatctctgtagaatcgaaccatacactccatatcgccagctaataggcacgcgcctattcttacttcttttccgaccatattatattctcctttgttgtcatatcattcatttagccaattccgatgctcccaggcaattgtattttccagttcaaccaatccaaatctatcaaaataatatggattctgttctgtctgtatccgtttccaggtttgggtatttttcacgcaatttttcaacgaattcctgcgccttggaaatatcactcttcagcatttcatattctggctgtgtgataccgacaagctgaataaagtctgttcttccataaacagtatctattccgtgtgcttccgtatctgatacagtaagaagtgccgtgattgcagtatcggagccccccttgatcggttctcccttatttccaataagctgatagggttcgaaatagcgttcagttgtataggtatagcgtgcaagattcgacagcacatctatggcccacatgcagtcgtccgtatttgcagctgaaagcttcatcgtcatctcgtagccccatttactccagtcgccgccaaagctatccttttcagcataaagctgcgtcataccgtaagtaacaatatgcttgtacccatttggcgatgaataaacagaatagccatcaatatattggtctccgccgaatattgcacgttttaacatgtttgttccgaaatgttcaggagtctgattcggatacagctcatcaaacacctcatctatggcctcccagccaggcgcccaatcttcctcttcccccagctttttaataaattcttcgtaggacatcatatcattattttcctccgcagcttccgtttttcctttgaagccttttttcttttctttccttttttgctgttttatcgcagacggtcagtgattttctggttcatgctctgtactccttttcaactattgtttaaccatttttctttcagcgtttgtctcagatgatcgtttctcctgcgcataaagtctgtgtatttcattatatcatttcttctgcttatattctatttttatctttcttaaaatgagtttctccgacaggaaacaacagcagccctataaaaagttgatacctgaagcaaaaaagaccaagcgtcatggttcgcctgatcttattcaaacatttttacattcatatactttttacattcaaacacgttcacattaagaaggcacataattcagaatccaaatgcatttcccgtactcactcattacgaatccgttcaccgctgcctaatctcaaattccgccgcaaggtaatatgtagtataatcccctgttccccggaaatcgttcacggtctttatgatccggtaattccccggctccatagagccatgaaatatctcccaattgaccgttatctccgccggactcccctttcgggcctcatagccaaccgagttaaatgtccagttgtcaattatatagggaacgctttgccactgtccattcacgaaatgctgtaattcatagttttcgccaaacatgatatccaaatccgtctcattcaaaatacagagcttaaccgatccagaatcggcactgccttccaccgctttcattgtcactccatccaacgtattgagtccatcctcagccttttcaaacagaccaaagccactgttatatttaacataaatacgatctggctcatccctgttcccatagacttcctggcctggatccagcctggaggcatgaaaatcctctgatggatattctgtattgtctacggcagcaatggtgccggccttttcaaatccgtctcccagcggcagatcaaatccatctgccgtatagagataaagcgttccattgtaacagacacttgcacgctgtatttcgccggacgggtagcccgtcggcgctgtctgttccgcttccgctttctggttcgtctgtgaaacgactccccccttgctgctatagaccacaagcaggacagctgccgcagcagtccagatccatctccatctccatctcctgcttcccataccattgcactccccgttcttgaaatatttggtatattaagtatactatattcgggcagaatgaggtattacgtttctcttgcgaatgtttaaaatttcgatgatgtttcctcttaaatggtacggtattctgtttctgttatataatcatacctccaatatttcctttactgtgatcgcttctgcctgttttctctcgatggacatatatattggcaagtcacctggacaattggaaaagtacgcaaatgcctgcagaaatctataaaaaaatcgctgggcaggtattacagacgtagtcgcgacccctatttagcacgttatataaaccagatggaaatctgacaaaaagcctcttagagtataataaacatattgatacatatacgacaattaccaagaaaattggaaatttcttctccagatctcacagcaatatactcttaaatacagtatgatttacacttttaaatataagatgcagccattatgtaaaagctatcatatttctacgcatcattatccggtatcatcactttgacggtgtttttgaaataaggaatgctttctatggtgatggtgacttctccataataggcatttagtctttgataaatgttatatagacctacgtgaccgcggctggtctcgtgttttggaggatagagagcggaattggcgttttcgatgttgatgccacgaccgttgtcagagacttcgagcacgatatgcccctcctctttcataacatgaatctcaatggcaggcatcagaatattatcgtaacagctgacctccacgtcaaagccgtgtcggatggaattttcagccagtggttgaaggatggatttcaaaataaccagatcttttaagtcagaagcaatcgtgtattggaaatcgatctttctgttgaaacggtgattcatgatgtctatataggctcttacatgagtaatctctttggagatggaaatcacttcattcccgtagctgaggccgatgcgcagaaaatctccaaggctggtaatcattgaagcggcagcctctttatgtccacccaagacctccatgttaatgcattccagtgtattgtagagaaaatgagggttgatctgttcagacagtaattgaatctctgagcgatatttagcccgttcgctctgcttaatgcattcgaactgctgctggatagtggcatacattgagttgatagccatattcagatgcccaacctcgtcattgtatttcgtctggtaaggtttatcgtaagtgttgctctcgatgctctgcacattggtgattaactgttcaaacggtttcgtcacaaatcgggacagcttaaatgccagcagggtggtaattgccaggcccgccaatgcgatgaatacaataaaagtgttcattctggcgatcctttggtgcaggagcgttttcgggaggatactgaccagcttaaggccgcagtagtccagatttttgccatacaggccatagtcacggctgtcatagatgaactggatgtcaacttcactgtctatatcgcgtacctgttgggcggtatccttggacatggcaatggagtaataaggggaattctggtccaggctgatattttctccccactggttggctatatacaaattacgttccgcataggcggaattggacaaggcgagacgctgggcgatactcttgttgtccagcagcataatgatagtgacatccgcttgttctgcggtcctagcaatatggaggtattttgtattctttaattgttcgataggaaccacaacaggtacaataatattactcttaataaatgggctttggcgagccggcagccatgtgacgccatccacagaagaaaggtcccacccgaaataagcggcgggattttcctccttttttagtgtgttagtaaacagtgaatagaattccccgtttttgccgatcactgccatagtatccagtatcgggttagacagagccaagttagccatggggtcctgaatcaaagctttgtttctcccataatcagcatgatttccatcgtggacatccctggtaatcttgctgaagtctgcggttgatgcgaagtctatcacattattcagaagcgtattataggaatcgctgagggcctgacttccaatttggagggaatcggcggtctgggcataggtgtcctcgtggtagagacggacaaaataccaactggtcaaaagccccagaaacacggacagcgtcagtgcaatgcccagcatacagcaccaaagcttagacgatatttttaaatttgcaaaataagcagttacttttttcataaaattacctttgtcaatgcttcgtctgatattcagaaggagtcatacctgtatagtttttaaatgcccgataaaaagagcggtaatcatcgtaccccacggcataagagacctcgctgatgtttgcctgttgggatgccaataaatgtttggcatgttccattttcacttttaacacataatccctgaaattcactctggtttttgccttgaaatagatggtaaaataggaggcgctcagattgacatgggcagccacatcctctgcttgtatctttttgttcaaattatcatggataaactgtttggcatccaggattatcccatctcttcggtcggatagatacttgctgatcagcctggcatactgcagaaacagaccagtcacccactcctcaatctcgctgaatgtggtaagctggttgataacccgatacggaaattcgggaaacagattatcctcgttttggatctgtttgcgaagcgcattctgaatatcagtcaccagatagatactcattccgcggataaaactaggcggcggcataggcacgtacaacagagagttaaaatatgtatgacaataaatacgaatagtttccatgtcatttttacacatcgcatttaataattcactggtatcgacactgctggtggatagggtaggcgccttagtacagattacggtatcatcatagatatcacgtttatcttcatatagctgataggtgagcacagtcagtgctttactgtaggagcgagaaacatataacagttcctgttcctccgagccaatacctatggtaactttcacattttgtatccttcgaagttttctcaggcaggtttcagccagttctacagcagaaacctgtccggcatggataatcaacacaacttgggatgagttggcttcccacacaacaccgtgaaacgatgaggtttcagctgtaacaatcgccgccacattgcctgccgtttccgcatcaaggacgttttgctttcccgtccggcggagggaaaatacgatcacctgacagggcaactcccccagaggcagctgcagttctgctagctttttctgaatatcgctgctgtgatggaattcattttggatcagctggtttaaaaatagttttttcgaagaaatctgtagagaacggtaatcatctggagcaagagcagcactctgggaacgctgttgcagcacttcttctttcaggccctccagttccgcagccaattcaccaattttcaaaggtttcagtacataagccctggctccgtagcggatggcagtctgggcatatgcgaaatcatcatatccactcagtatgataaattgggtgggcagtttgttgtcgcggcaccgcttaatcagctccagtcctgtcatcttgggcatacgaatatcggttatggcaatggaaggtttatatgtctgtatcagttcccatgcctctcttccatctttagctgtgccaatgacagacatgcccagttcttcccagggaattgctgtcctcaaaccattgcggatagaagactcatcgtctgcgatgacgacgcggatcatctgaccgctcagaacagccacctctccgcctgatataagattcatttccattataggaaagccccctttcgtactttatagtattcggtatccgttttgttgtaccaactaaaatattgtaagaagtataccacaaaagagcaatatttttatgtatcattgtatattttattagaaaatgcaacatttatattgaaaaatgtcattaatacatacaaaaaaagctgataatattagtgcatcaagcaaacaacgcacaagaaatgaaggaggataggtatgaagaaaaaaggattaataagtatggtgcttgcaggagctatggcagcatcacttacaggatgcggtggtggtgcaaacacttccacaacagcggtgccgacaaatgctgcatctgaaaagggcggggaaactcaaattcaaccaacagaagctaaaaaagaggaatccggtgaaaaaacagtgatcacggtttggactcaggaccgccatgactctgagtatgtggaatccaaaatcgaagaattcaatgcgacaaatgaaaagggaatcgaaatttctttaaatgttatcacagatgattatccaaatatgatggcccttgcatattcttcgggaactgcacctgacatcgcaggtattggcggtgctaccagtggttttgatttgaaaacctttgtggaagccggaattattgacccgctaaatgattatatcacagatcctgaatatgagaaagtgaccgaagcgagtacccttcagttcgaagggatcaatatgattgatggcaacgtttattggatacctaccggtatgagaagtggtaccagaattgaatataacaaagacctgattgaaaaggccggatacacagaattccctgatacgctggacggggttgtggaactggctgacaagatcaccaaagatggaaatggtacttattatggtgtaggcttcacatcttcagttccatttaacaggtggttggaaggcacggctgagacaagcggtatctaccgttacgattataagacaggtaaattcaactttgatggatataaaccaatcattgaaacagcaaacaaactctttactaacggaagcgtattcccaggttccacaacacaaggtgtagacgcgatgagagcacagtttgtagaaggaacctatggtatctggggcaatgcgtcccaagaagcaggggtcttcacctcccagttcccgatcgacaagttcgagtggggcgtagccgaagttccaagtcttgacggaacccgaaaaggtgcacagaccatccagccccagaagggttacatgatgttctcctccagcaagaataaagacaaagcatgggaagttatcaaatactttagcagcgaagaattcttaaaaggatatctggaagcaggactatatcttccgatctccaactacatggatcgcaccatagacaagaccaaaacaggacgtctggctgacttccagctcacagattatgaaagcgtttatcctgctgttccggcaatttcactggaaggtgatgactacggcacggttatctggagagcaatcatgggagatataagcgcagatgacgcgattgctgatctaaacaaacgttacaacaatgctcttgaaaatgatatcaaattaggaaagatcaaacgtatcattatcaaagatttcgatgcgcttcacccaagccagggtaccatcgaatatacagaataattgtatcaatgcagcaattttaacgtgaaggaggtgttgcaagttgactggcataagtcttgcagcgccttttttctctggtaaatatactgccgtttagcggcagattcaggaggtagttatggaaaataagggtaatttatcgttttccgacagggttgtccgggccaaaaacaggggggatttcacagcatttttcatgcttcttccatctgtattcctcttaatcaccatgtccgtttatccatttttctggctttttcgatatgtatgttacgattataatggatttaaagcctattatacaggttctaaaaattttatgcgcatgctgagtgacgaaacattctggagaagtgttctgcatacctttgaatacgcagggctaaaactcattatcatcattcctttatccctgcttttagcagttctgttaaaccagaaattgagaggaacagggcttttccgcggaatttatttcatgcctaccgttatcagtgctgctatttatagccttatattcggatttatttttgctgtatacaatggtgtcttaaacgcatctctgcataaaatcggaattattaatgcgccaattgattggttaggcaatacgggcatcgttatgatctccattgtcatcgtggcagtctggggcggttttggtaactatatgattctgtttatctcaggcatgaccagtattcccgaggaaatctatgagagcagtaagatcgacggcgccgatggagtacagaccttcttgagaatcacccttccgatgcttagcccagtactcaaagtaattctgatgctcgctatcaccaccgcatttaaggactaccagtcaatcctcgtattgacagacggaggccccaacaaccgttcgcatgttatgttctcttacatatataaattaatattcagttcaagcaccacgccgcagatcggttatgcaaccatgctgagcattgtagctgctttgattatcggtcttataacggctgtatatatgtttgtagcaagaaaactagatgatgtaatttaggaggggtattatggaaaagagtcataccgtctattcaaaaaaaacaaaggtgatacgcttcctgctggtagtatttatgacggttctggcagcactgaccctgtatccggtcatctatattgtttttgggtcatttaaagaaaatgcagaattactccgcggcgggacgaagctgcttccggaaaaatttatccttggtaactataaggaagcatggcaaaaagccaacttcgccagatatacgataaacagtatcgttataagtctgggcgtaatgatcgtaactctgatctcaaccagcatggcgggttatgtttttgcaagaaagaatttcaagggaaaagagttactctacagcctgttcgtagcattcatgttcgtcaacgttggaagcgttacactaagaccattatttgaactagcagttaaagttaagatgaacacttctctgctcagcgttatcctgatcgccgcaggcacaggtcaggccacatatatcttcctggtaagaggctttatgagcaccatatcaaaagagctggacgatgcagccaaaatcgatggctgtaccttctttcagatttattacagaattactcttccgctgctgaaaccgattttggcaactaccggacttctttcctttcgtgcaggctggaacgagtacatcatgccgttggtattcaccatgtctaatgaaaagatgcgtccgctgactgtcggcgttaccatgctcaaaaacagtggcgatggcacggctgcctggaatctgatgtttgcaggtgctacgatctctatcgtaccaattgttgtaatctacatctttaccagcaaacattttatgagtggaatgacagccggagcggtgaagggctaaaatacgacattatacagaatgagaggttactttaatatgaagttatgtgcattaaattcaaacggattcatcatgcattatcttatctcaggacctaaagtggatacctttatcgatcatacccctgatgacaaccagcttcgctatgaaaaatatctccggtccatcatcacgcaaaaacaggatcatatacctgagcacacagtaaaactgggagaaaaaagcggattgggccttccatggcagtattattataattatgaaaactggtttgttgatctgagtacattttattctgagctcaccaaagtggcgctggattcctgtactcagctttatgcagagcgtgatatggaagtaaaggcaattatatggtcctactcttctgtggatatctggtgcaatgaggaacatgtgtgcagcatggctcctccagtttataagccgatccgccggcaaaatatgatactgaagctaaaaaagggagtcaacccgctgtatatcagactccagaccctcggtgtgagagataccagaaccctattcggaattcagatcaccgagggggcggatgagatccacgtctgcctgccggacagcgtccataccgaccctgtaatcgaatgtgcagaatggttatcggccgcttacataaaggatgaagcagttcactttccatcacctgcacctgtaggaaccatgcttgggtatgattctcagactccagatttcagcaaggcgaaaacaaaggtggtccgccacggaattcgcgccgtagtgaaggaaaagctggaagcaggaagaccatatatcgtagtggaatgcaacgcacagggccagaaactgagcaggaatatggagaacatatctcaaatccttccgaataaatcaaaatgtcttagcttcgaagaaaataaaatggagatatttaaacgaacggctgcggtagaatccttaagccgcggcggaaaatttggtttttccatatccaatatactggcgcggcaggcgacaggacttaccacaccaaaagacagggaactgttcctggaaaccctttcccagattgagaaacgttttgactgttcggatttcctggtctgcggcctgattcgctatctgaataactatgaactggacgagaaattgaaaaacaaagtaaagaacgtgctgctgcattaccgtttctggatggatcaggaaggttcggacgctatgtgcttctggagcgaaaaccactccctgatgttctatgtgtcagccatgaacgccggaatgctttatccagacgaatatttcacacgtgcccatatgacaggcaacgagttgtacgaggcgggcaaaaagcgggtggaacagtggctggaggatgtggaagaacacggttttgaagagttcttaagtacagtttatatgtgtgtgacatttgccggacttctcaatgcaattgattatacgccgaaagagatttccgacagggcggttaaggtgacagaccggctgctgggcatgttggcaatgcatacttataaaggatcaatcatcgccccaatgggacgtgtataccgtcaggtgatctatccgttcctacagggcgcccaggctctcatgaacctggtaaatccggaagttccctattcctatggggaaggctggctggcattctatgcgaccagcagataccaaattccggatggcctcgcagaaaagatgaaagagtctgtatctttggaatatgagacgggcaatgccttgattcggctggaaaaaacggcacatcactgtatgacttcggtacaatcgccaaggcaggataaaggatttaaacgctggacgaatctgactctgattgaagagacgaatctcatagataagaagacacatgagtataccaaatccttaaatgagcgttttcacggcactacctgctttgagcctggggtgtacggctatcaacagcatatgtggagcgcagctttggacagtgaaactgaggtattcactaaccacccgggggggacctgtgattccagtcagatgaggccaggatattggtttggcaatggtgtgatgcctgcgatccgtcagaaaagcgggattctgggagtggtatacgtaattccagaagagcatccgatccactttacacacgctttctggcctggagtgaagtttgaaaagaccatatccgagactcactggctgttcggtgaaaaggctgggggatatctggcactttggtgcaataaacctatgaaagttcatcaggatcagatctttgactgtgaatatcgaagctatggcgatgaaatcgcctactgctgcattgtttccggaggcggaaattgggaaacgttcgtcaagcgctgcaaagagattagtccggtatacgatacagaaaaaaagatgctgaaagctggtgatctggaagtaatttacgaaaagcactcggatataacgcagtatatttaacaggataaaatctgtccttccgtctgattgctgatctttataaaagaaccgggtaccgtcggtactctcaacgattcaccgaatcatctcacgtggcagaatcccaaattttttatgaaatgactccgaaaaatgacttacgtttgtataccccacggcaaaggccgactcactcacattatgtcccccctgctctaatagtgcaaatgctttttccagccgctgttccctgacaaattcatagacggtgttcccgaagtactgtttaaaagagcgtttcagcttgcagtcgttcatgcaaatcatacgggacaattccagcagagaaggcggggattccagacggcttaacagaatctcgcgtgcataggttaaactctcaatatcggttctggtgagctggcttatggaatcccctccgttgtccctgcagagcagtctgtcaatattgatggacaacagttccaggatataactttccatcaagagcttattgatcttatttgtttcattgataaaacacagatccagtttgttcatgatactctcttccctcgcatcgcatttaaagccataagaggagtaagaatccttctgaaaggagcgaaaccctatattgcttttaccgcagacagcttcacaaaagccatcaaacgagcatgggctaacccaaatagaatacagatgcacctcttggccgctgtgatattctgaatatgcactcgtttcacccagaaaccccagcgttgcatatccaggcctcagttccacagctttgcgccctacttctccgcaaataggggctatgcgggtataactcagctcaaacgcaggagatgtggtaccagatttcctctttaccagatcggaaaatgtaccggaagaaaccacgatatgtacatctggccgtatcgcaatgatttctttcggaaatatattggatgcctcaaactttaatggtaaatatgacattttcacccatcctttatcatgtcccgcccgggacaatgaaaatacgctaaaaaacagaaaacagattatgaaccgactattattatagttagtttttcctaaccagtcaatagggacaatccatttatgatggttaattttaatcagtaatgcaaaaagccgctgacacaggcaattccgtcaaggggcaggaaacctccgtttcagggcagaaagaaagtctgctttttcgtatacttgccgaagttagccttttctaaccgctcaaagtataattcatttcaggaggttccaagtgaaaaagaaaattacaattccaattattatcatgatggctgcagcactgaccgcgtgctcgtcctcagcaaatccatcacagacatccgggcaggcggcagcttccgttgcggatacaaaaccagaagcgcagcatggtgataccgttacggttgaagatatgaaaggcacggttgaaatcccggctcatccacaacgtatagcagacgtttcgggtctggctgatgaactgattattttggatatgccatttattgcttcggctaataccagtatgtttgacggcataacagtgcccgattatcttcaggaatatttcactcaaaacaatgttgaaaccgtaggcaactattccggagcatccgcttccggtgatttaaatctggaaaaaatcgccgagctgaagccagatctcattattatgaatattcgccatgacaaggtatatgaacagctcaaagcgatcgcccctacggtcatgatcaccgacgacatcagctacgtcaactggaggggacgttttcagcagcttggccagtggtttggcaaagaggatgttgtaacgcagtggctttctgactatgatgcaaaggcagcggagctttcagcgaaggtaaaggaggtggttggaaacgagacttttgctgttctggaagcgaattcggtacattttggttcctattacgtttacaggaccggaggtccgggtgagctgatctacgatgagctgaagctggctccctcatccggtgttccggaggatgtgtggggagaggtcgttgatgcggaatacttctcgaaaatcgatgcagatcatattttctttttcagtgatgacggagaggttggagataccggcaaaagccctgtctggcagaacttgaaggcggtaaaaaacggaaacgtatattacggtaagaatgaggcgcagtataatatggcgtacaccgcgaatggcaagctgctgtatatagagaaactggcaaatgccattataaaccaaagcaatgtcgagtaagccacaagctacgacctcttctccccgcatgcccctgcaatggtttcgcacacaagcgggctttgcactttccatggttctgatggtgtgtatcctgctgttttctctcctgttctcggtcagcatcggagtggcaggcggaaatatacatgttttggcggatgcgatttttcgcccggcacacttaactgatctcggaagaattatgctcgtgatgcgtatgcccagagcactggccgcatgctttaccggggcggccttcgccctttccggcggtgtcatgcagggcgtaacgagaaatcctttagcggattccggacttttagggatcaatgcgggggccggatttttcgttgctctgaccgcagtcctttttccctctttaccaagcatcggtatgatgctttcggcttttatgggggcggctctggccgtgctgctggtctacgggctgggaaccggcaaacacaaaacaggggctgtccagcttatactggccggttctgcggtttccgccctgctaacggcattgagccaaggggtctctctcaccttcggactctccaaatcgctgtctttttggacagccggaagcctgtccgggattacatggcagagccttgtcctgaccattccatggattttgggcgcaggttttgtcagtctgctcctctcagggcgattatcgatcctggctctgggggaggaaagcgcggcggggcttggcataaacatacgggcggttcgactcctcagcacgatcgtggtacttattctggctggtgcgagcgtatccctggtgggcggtatttcatttctgggactaatcgtccctcacattgtacgcttcctcaccggtgaggattatcgaagacttttgccaggctctgcacttttgggggcgattctgcttgtccttgcggatgctgcagcccgtactgtccacgctccttttgatacgccggtcggcgccctggtatccgccatcggcgttccggtctttctggcgctgacatatcggaagaaaggagcgattctatgaaaaaggaacgcaggcagaaggctgtaccatgggttctcctgatcgcaatgatcgcggctgttttactatccgtcaactgcggatattcgaggattccctattctgatgtcatagcaagcctgctgaatccaggaggtcccaatgcatctgtcattcttttgcagattcgtcttccacgcatcgttctggccgtcctgtgcggaatgggactggccctgtccggctgtgtcctgcaggcggtgacagaaaacccgctggccgatccaggaatattgggaatcaacgctggagcaggctttaccgttatgctgtttttaacactatttccagctttgcacaccagcacaatgatctatcagcccctcttcgccatggcgggaggtctgctggcggcggtgctgctgtacgtcttttcaaaaaggaacgggaaggtcaggccggcttacctcttgctcggcggtattggcctttcagccggattttcatctgttatgctgattatggcggctgacatggaaaacagcagctatcagctggtggccagatggctggctggtaatatctggggaaccagctggtatcaggtaaaagcgctgcttccttatctgctgcttctgattcctctgcttttcataaaaacgggggttttagacttattgcttttgggagaagatgtctcccttgcgctgggggttcaggtggaaaaggaacgaaaaatcttgctggctgtggctgtggcgctggccgccagctgtatttccgtcagcggcggtattggctttatcggactggtcgccccacatatagccagaaaatttgtaggcggacggcatcctttgcttcttcccgcatccatgctgtttggcgggctgctgcttctgcttgcggataccatagggcgttccctttttggccccatagaaataccggtcggaatcgtaatttccgtcctggctgcgccctattttctcattctgcttcgcaggcagatataaggaggttaatcaatcatgaaatcctgtattacaacagacaaattgtccgccggttacagcggtgtcacagtgttccgggatatcgatctggagatacccgccggcaaaataacgacgctgataggctccaatggctccggcaaatcgacgattttaaaaaccatgtcccgtctgattacgccgttgtctggtacggcctgtctggatgggcagtccattcacagcatgccgactaagctggtggcccagaaactggcgctccttccgcagggtgcgcaggcaccttcggggatcacagtaaacgacttagctgaatatggacgtttcccttacagaaataaattatcgggacttacgcagaaggatcgggaaatcgtccgatgggctttatccagtacaggcatgacagagcttgctgaccgggaaatggatcagctgtccggcgggcagcgtcagcgcggatggatcgcgatggcactggcgcaaaaaacagacatattatttttagacgaaccaactacatatctggatatttcacatcaattagagatactgcagctcctgcaaagattgaattcggaacagaacgttactgtggttatggtcctgcatgacttgaatcatgccatcatgttttccgattacctggtggccgtcaaggatggaaaaaagcactgcgcaggtccgccagagagtgtaatcacaccggagacgcttcgcgaagtctttcaggtggaggcggcagtcgttcgccatcccgttctggatgttcctgtatgcctgccttacagcgttcgggggcaaagctttcaaaagcagaaccagcggcaggacacgcaaaatccttaaaatcaggccactcccgcccattttcgatcgcgtcctgaataccgtgataaaagcgaaccttatgccggatatgctggagctgctcctgcatccgttcgattcgggccgtaagctctctttcgtgtccttcaatcaggctgatgatatcatcgatatgagtttccagattatcctcatactgataaaattcgaagattttggcgatgggaagtcccgtttctttaaagcacttgatccccataagccgtttcagctgagtttcgtcatagagacggagaccatttttgtctctctctacatcatcaatcaatccgttcttctcataataccggagtgttgacgaggggatatccattatttcagatacttctttaattccatattttttcatcattgtatacattcctttcgctccgctcaatacacaggcatgacctgaaatttttttcaaaaggggggcaaaaactgttgacttaaactacacttcaagtgatatgctttaggtgcagacacatgaaccacgaatatcaaatcaatactcgcaggaggcttaaaatgaattatcgcaatgtaggtaaatcaggattaaaaatcagtgaaattgctctcggaagctggatgaccgacctaaaagggacggatcaggaggaggtcgccagagagactgtaaaactcgcatacgaatccggtgtcaacttttttgactgcgccgatgcttacagcggaggcgcggcggaacgctttctcggcgaggctttaaaggattatcccagaaatgaactggtcatatccagcaaagtctattttccgacaggaaacggaatcaacgacagaggactttccaggaaacacatcatggaaaactgcgatgcctcactgaagaatatgcagctcgactacctcgacctctattactgtcaccgctatgatgaatccacccccatggaagagacactccgtgctttaagcgacttagtctccaaaggaaagatcctctattacggtgtcagcgaggagtggggcagcgcacggcttgaggaggcggaacggatcatcgaccatctggggctataccctctgaccgtcatccagccgcagtataacatggtagaccggtatatcgagcatgagatcatcggaacctgccggaaatacggcatcggcatcacttccttctccccactcgcacagggtcttcttaccggcaaatacaaaaaaggccagccttacccggaaggctccagagcaacccaccaatcggataaacagatcaatgccctcctgaccgacgataattaccgcctcgtagaggagctttcaaaaattgccggggaactgggtgttcccctctccgtcctgtcattggcatggatccttcagaaggaagaaatctcctgtgtgatcgcaggcgccagcaggccctcccagcttgaaaacaatgtaatggccagtgggctcaaaatcccggcggacgcgatggagcgaattgaaaagtgtctcccgtttaaacggtttgaacgtcatgtaggataaagcagagccaggcaacgaaattccggccctctacagcatctatgatactgaatggccggaactctgccttcatcctgtttgatattctgcccgccgcttctacatacccgtcacatcctgctccagaagtgcaagcgccccctccaggtttccggcctgaagctccttaaagattgcgtgatggggcgtacttgtcacagaatccgtcatactggagctgctgttccatatcgtctgtgcatacacccgtttctgcatcttcatacagtcgctgaggaacttcatcaggatcctgtcatccgcaaaggaggcaagaagcatatgaaattcctcattatcttcccagacagtccagacatccacattctgtttcgacgcggcagccgtaatctgcttttccagctgctccagctgcatctcgccgattcgctgcccgcaaaacgatttttttaatgcctcctgttccagcagaatccgcatttttatcagatcgcgcctgtcctgttctttaatttgtacgaccacatatccgtatcgggggatattgcgaagcacgtcttcactgcacagcataaccagtgcttcccggactgtagctttactgacaccaagcaattcgaccagccgcttctcattcagcaccgccgcttcatccgatttgcttttaataatcatctctaaaatctggtcatgaaccttttccgtaagagaaactgttttggctttcgaaaagccattcatcaatgtatccataatcatcttccttccaaactgccggtacagcagacattttataaaataattaaataagtgctataatttgagaatacacgtttttctcttcaattacaatcaattttttactttggtttctgccgaatcgttattttttataattttcccagcagtacatcgtagcatcgcgccgcctctttcagggcttctataaaaactgactcattttctccgtgtacgcctctgccctggaacggagccgaatacaagggcgaaaaccgcagtatctcatccgttatatgacagaaatgtttggaatccgttccgcctcccaacacaaaagggataaccggaagccccgggtacgcttcattcacactggccttcatcacccggtaaccgaagccctcctcactgccttcaaaagaggcatccgtaccgcctgccagttcacagcacacaccatggcgttctgccagcgcttttaacttttccgtcacttctttctccgtctcaaccgaagagacccgcacgttagccgtcagcactgcctctattggcattacattaaatgcagttccgccctgaatcatagtgaatgcaatcgttgcgcccagcatgctctccgcctgcgggcagacctccttaaggagcgtatacggttcccggtcctccgacgcggcccgcagccgctttctcgtctcttcaaccgtacagtactcagccgcagcgcgaagcgtcctgctgactgccggacttaattccctatggaacatagctcccccctcggcctcattgatcaatccggccagcttgacgattgccgaattgcgcggtgcggccgctgcatggcctccttctgcagccgatgtaaaacggtactccagcgagcccttttccgccactccgaacagggcggcacggcccttcaccagccccataaagtcctcacagatggttccgccttcatcaaaaaccgtttcaaagcggatccccttcttctccagcacccttgctgcctcacatgtcacagcaccgccagtctcttcgtcgcaggaaaggtagagccagacatcccgcactggcctccagcctgttttaagtctcctgtcaaaggctgaaagaagggcgcactgaggtcccttcatgtcctggcttcctcttccccacacgctgtccgctgtgacagtcccggaaaaaggcggataatcccagccatcactatcctttgccgccaccacatccatatggccggtaaacaggaccggtaggcttcctgcctcccctccgctccccttaatccggcacagcagcgcatccttaaccggaagcactgctgctgtatcaaatactgtgtcaaactgcgcttttaagtagttcttatactcatcgatcctgaattcgcggcagctgccgtttacggttggaatgcggatcatccctgccagtctttcctcgattccatcaaactttattttttccattttactccttcatccccgataccgcaatgccctctacaaagaacttctgtgcgaagcagtagagtataaaaagcggcagcatggagatcagcgcccctgcaagagccggtcctgtctctctcactccttcacccacgaacatggcaagccccgcggacagcgttctcattttcgttgaatctgtcatcatcatcggatagatcaggtcattccagtttgaagtcagacagaaaataaaaaatgttacaaatgcaggcttacacaacggaaacatgatttttgtaaaaatgccgaattcattcatcccgtctattctggccgcctcttccaggctctttggcagtcccgtatagaaggatctcataaagaacatcccatatgccgaggaagctctcgggagaatcagaccgatataggtattcaggattccgaaggtatgcagctccagatacagaggaatcatgatgatctggaacgggatcagcatcgtcagaagcacgatattaaacaggatttctttccccttaaactccagccgcgcaaatgcatatccggccagggaatcaaacatggcagaacagaccgataccagccctgcaaatatcactgtattcttaatgtaacaggccaacgggatcctgtcccacactttaatatagtttgcgatcgtccagcgcttcggccacagcgtgggcggccatttgatgatgtccttctgcattttaaatgtactcatgacaagccataaaaagggaaaaacgatcaacagcagaacggccaggcataacagtatccggattacattataaacttttctctctttcttcatgtctgctcctcctacatgttgtttgcgatttttctttccatataccccttgaatataaggatgatcacggcgatgaccaggaacagctcaatacacatggcggaggcgtatcccagctcatacggctccgaaaagcctctcagataaatgtactgcaccatcgtttccgtcttgtacatcggaccgccgccggtagtcacatacaccacatcaaatacctggaaagcgccgatcagcgtcgtcagcaaggtaaaattgatagttgggagcagatttggcagtgtgataaagaaaaactgctgcagttttgacgctccgtcaatttccgaagcttcaaaatacgtagtcggtatatcattgatgccagccaccagaatgatcatcgtctttccaaatgccttccacacggaaaggaatatgataatcggcatggcgaaccgttcatccgccaaaagcgccggcggttctcctgtaatcctgcttatgagaaacggaatataccccaccgtctggtttaacatcaggctgaataaaattccaatggccgtgaacgagcagagcacgggcacatagaacaccgaccggcacagcttattgaaacgggtaggcttatacagccagtatgccagcaccagcgctatgatgagctgagtcggcactgagagtgccacataatagaacgtattgcgaaatgcgttccatacccgcgcgtcacccagtgtcttcttaaaattgtccagtccgatcatcttcggccattccagaaagatatttaaattcgtcagactgattacaaacgatacaagcaatggaataatggtaaatacaaatagaaataaaatagcaggaaagacgaagagatatccaacccggtcttttccaaaccattttgccagtccttttttaacagttctgtttttctccatagattcggcttcctttcagcccggggccgataagcagcggtccccgggcatggcatctgatcggtttacttgtccaatattgcctgaataacctgattgtatttatccagagtcgccggaatatctgctcctgcgaagacctccccaagcgctgggtataaagcatctgtggcgattgaattgacaccgtgaagcttacattccacatggccgtatgaaaggggatcggaaagcgccaatgtcagaggatcattttcaaactcctcctgggcagataacagataggccggcgtcccgcactctcttgtccatttggaacagatctctttcgtattccagtactggacaaatttgtagacgaggtctttatgctcttcggaagttgttttcggaacagagaagccaaccggaatgatggaagcatccttttccatgccttcgcaggaaggaaccgccgtcacgccgaagttgatctcattttcccgcagcccgttgatgatccacggcccatctataaactgtcccattcttccgctgatgctgttattgggatccccatcctttggggagtaatcgtacataaccttcagtgactcgaacgcctttgcattcgcctctgaattcagcagggcttctgtctcatctgcattcgtatagcttccgccataggcatacatcgcgtactgaggaacgacattattatctgtcggaacgttgaatccgtactgatttttgctcttatctgtgagaatctctgcatttttcataatctcctcccaggttttgggaggggtctccggatccagccctgccgccgcatagaggtccttatcccaatagagatagtgagaaatcacctgcatcgggattcccacgcaaaggtcgtcgtaatacagcaggtctacaatgttgggatcaaagtcagccttatcgacgcctggaagctcataaaaatcggacacatcctgaaagcttccggattctacatagggaacgtagtaaccggtagaacacagtacaaaatcaggcgcatttccggatgcgatagccgccggaagcttctcattaaaagtcgcccatggcatggcatccatctcaatcgtaacgttgtattcattgctttcattgaaatcattgacaatctgctgcagaacgtctccgtccgtgctggtaaaaccattccagaaggtaagtgtcacaggcttatcgctgccggtctgtgaacctttcgtcttttccggaacagactctgtatctttttctgaactgcctgagttgcctgcatttcctgagttgtctgtatttcctgtgttacctgcatttcctgaaccgccgcatgcggtgagaccggctgccaaaatcagaatcaaaccggctgctgccaaacaatttttcctcatatttattacccctttccagacattcatctatctcttactcttacaggcttctcgcggcttcaactacccagcggattctttcccagtccagcctggcatcaatggtgcagtcaccgcccagcatcagaccagtctttccatggtttaaaatcagctgtttcgcgtattcctgaagctcttccttcgttccgttgtagataattccctgctgtatatgctcatcccagtgtgtctcgaatccgcccagcgcggttcttccttctacaaagcctctgccctcctccaggctcagaccttctacatagacagcccaatttacaaccttagccggataatctctccataagtccaactgattgcggtttcctgcccatccgcacatatgaagcatattattatctgaatagcggtttgcgtgttccagtacatacagatcactgggagtgatgacttttctgtactcctccggccgaaatctgtcgtactcgccgccctgcacacagtagtaaacaccgtcgcatccggcctctgtaatcaacagctctgcaagaagggcgttggactgtgcgattgcatccagagcagccatcacggaatttttgtcttccctgatatacttcatgacctctgcatccggaatgcctatggcatccgcaccaaatcggagtgaggaaaacggtgcgaatacattataaaagacgcagcgctcttttccgatcgctttaacgattgccttcgctctctccacctgttctcttatgaagggatcctgagcggacatgggctttacgtttctccagtcctctccctttttgatctcgggcagcggataattgaaatagccgtcacacataatctttacaaaatccagatccgtttccctgtaatactttaaatgtgcttccacacatgcatctccggcggcctccgtaccgccgaaatgaaaccagaagccaaccggtacatggtctacctctttcttattcatcgcattcaacactctggttctcttatccatcttgttcctccttgaatttataatatccggcggtatcccaccgttatttatcgtcgtcaacgtttctgcccggtcagctgcataccatcatgtccaggatcactctgtcggtgtctgccatgccgcggttaccgagttctcctaagtttttaatcgtactctccacgtcttttgcaacaattccgtccagattaccggcgctcttcttatttaatgccagcatggaacactgaaatgcaccggatacaaccgttcctattttcaatgcacatccggcctttgcaccgtcgcagatgatgccggatacatccgcaatcatattccggatcgcgctcttaatctcttccattcctcccccctgcatatagacaagggcgcagcagaccccgatggaagagcccataccacagccgcacagaggagacagcttgccgatatactgctttacatgaattgtggtcaggcagcttaaggccagtgcccttaaaagcttctccttatccagctccatcgcctccgctgccgcgatcacagggagagttgccgtaagcccctgatttccgctgccgcatactgtcattacaggcagtgtgcttcctgacatcctggcgtcggcagccgcggcggccatggctgccgcatagaccggaacattttccttaagcggccttccctttatgctttcaaacaggctctttcccacattgagtccgtaatcgcccttcagtccctcctccgctgcggtgcggttcatgcggatgcattcctccatgaactcaaatttactgacttcctctgaaacgacgaaccggtatatctcctccacggtcagcccctgcccggaagcttttccctcctgaagctcttcacagctgtttttatcataaatggaggtcaccccccggaatatctttgtaatattggtatggctgtcttctatcacgacctttgaagaatcatccgctgtttcaaggattatttctatgtacagcttttgcggcgtatcctttaaggaaaccgatacacgctcccttgcaaatgcttcagcccgctccacatcgcttttggtgatcttctgaagcacctccagcaccgcgtcactgtctccgccaataatccccagcgccgccgccatctccaatccgaccatatccgtaccgggaattccaacacccatggcattctttaaaatattacggctcacgttcaccactgccctcaccggcatctttcccagcacttttctcgcttttgccgcagcataggcaatcgccacaggctctgtacagccaagtgcgggggcaaattcgtgttttaagatttgtaggatttgcttattttccatctcatactcctttgatttttctatagcctgttctgtatccatgttactgacctgttcagtgatatggacattatataccactatttaaaaaaaagcaacttaattttgttaaaattatcattgcattttctccagtgcctgaagactgccagatttcctactacacaaaaagaccagacgaaatacttccgcctgatcttctttaataactttcacgattctggttatcactccgctgccccattattgaaccgtttccgtgtccctataaagtttttcattctgaacatctgcaaggaaaatacagcctgtataccgcaccatgaagaggcgcttctcgattcgctgcctccgcctggccccccatatattccatcccggtcttaacgacagacagccctataccaaacttcccctgttccccccggtaaaaccgttcaaagatatgccgcagatccatctccgtaaacccggctccgtcatcctcaatggtcataatcacgctcttctcctgtagctccagatgaatatctacttttgtttctgcatatctggaacaatttgatattatattccggaaaatgcgggttaataactccgggtctgccaatacagtcacttctctgtgacctcgttcaaacaccagccgcttgtgatcggatattccctgaagtatctccagctgttcttctataaactcccccagttctatcttcgcattccgcagtttcagttcatgattatccatcttggttatggtaagtatactttccaccagatttgtcatacgcaggctttccacgagaataattcccgccgccttttcagggtctttcatcactccgcactgaatcccctgggcatagccggttattgctgcaagcggcgttcttaaatcatgtgaaacattctggaagaaacgcatatttttttcttctgcaaggcgcagccgctcttccatacgattaaaagcatctcttagtttttccaattccagaagtgaataatttcctcttaccggactgctggctccgctcctgatttcgtccacctgacagcacagttcttccaaagggtctgcaatacttcttgccaccatccatactccggctcctgcaaggaacaggcagactgccgctatgacggccatcagacggccggtataggccaaaagcgctgacatatccggggcataagcgtatccgataaaatattttgctctgatattgccggaggtctctgtctcaacctcataaagccttacacggcccgatccactttctgtgctgatatcaacactctttttgggcgttaaatcaccattttccaaaagctcaatacaggttttataaatatccggttccatactgctgtcatcggggtacacctgcttcctcttagaattcagaacgatcagttttgcttcccactctccctttttcaccttttccttaacactctgcagaagcgatttggaatactgccgttcttcctcgggcgtacttacctccctttgctccgcactgccatagatgattgacgcctctttttctatcgcctccatcaatttcgtcacatttttgcctgccatgtattttacataccagtctgaagtcatataaaacgcagaccatgcagcaagcgacaagaccgcaatgactgctagtacaggaagaaagatgcgtacatggattcgtttccccatctcttattctccacttcttttttctgtgatcctgtatccatagccccatatggtctccacagaaaccgatgcatcctgctgtcttagtttttttctcagccgtttaaccagatcatcctgcatccgggtatcctccccgcgtccttcattgccccatacctgtgtttgaagctcctgctttgagacagctgtttcctttcgttccaacagatacagaaggaactcaaattccataggtgtcaccgaaaacgcgtcttcatgcacagtcacttttctttcctgcgcatacagccgcagattcccacactcatacggaacccggtccgcctgcctgttgtcccctcccgccagttccgctctgcgaaacagcgccttcactctggctgtcagttccagaggaaggaacggttttgtgacgtaatcatcacttcccagggtgattcccaccacccggtccatagggctgtcttttgctgatacaataataatcggcacactgctgctcttcctgatttccgcacagatactcagcccgtcttcccctggcatcataacatccagtatcagcatatccggcatctggcgccttaaggcctccataatactgtatccatctgaaaatgtttccaccagatatccctcattctccaaaaagattttcatcagagaacgtatatttttctcatcatcggcaacatagatccgttttggcatagttctttcctcgcttttcttgatgtcatcttttacggtaatcataccatctaattacaaaaccgtaaacggctgccacatatttgccgcatatttactctatattactgctgttgatcaatgctatacttcaaatgcagcaaggaaacaagatcaggaaaggatgatactatgaaaaagaaattgataattttatgtacggcagctgctttcacaatgttagcagcattcccggcgctggccgccgaaaccagggccgagtataaggaagaggttacccccattcgcagtgaattaaaagaacttgaaggagtaatgaagcccctgcgtgatgagaacaagagtatctccgccaaatataaggcaatccgtcttcagaaaaaagagagcggcaccttaagtgtcgaccatgaggcttggaaaaaggcaagggaactgcggaaaagaatcacagaaattcgtaaagacatgggagaagaaacggtaaaatccatgaaggaaaaagcaaaagcagccgctaaagctaagaattttgattctgctctggaagaaatggatcatgcactgaagctaaaaaaactacgatttgaatctgtaaaggatatcaatgacatctggaaggaaattgatgaattaatcgggtaatacagacagatttccctgtcagtccaattgtttcctataaaattacgaacggaggatgcagaataaaaactgcatcctccgtttcgcctgattatctacaaatcaacagcagatctggaaagccacagagaactcctgtgtctccgcttagtcaggaacagaagtgtgactacggccaatataccggtctgaagtaggaaggccgcgccaagactgcctgtaaagcccattaccaggaagcccgcagcggctacggctgctgaaaaaatggcatagggcagttgggataccacatggtcaatatgaacacattgcgcacccgtactggacagtatggtcgtatctgatataggagaacaatgatctccgaaaacagctcccgaaagcacagcccccaggcagcagtaaagcattgtatcccccaccccgaggctggaagccatctgcacactgatgggaagcatgattccgaacactccccaggaaaagccggtcgccagcgccatcaccgctgaaaaaaggaacagtaaacacggcagcagctgggaagaaatctgatactcaatcagaaggccagataagtatgctcccggctctaacatacctatgatatcaatcagcacccaggcaaacaggagggcggtggtagctccggcaaccttttttataccggaaaatgcagtggaaaacagttcctttccatgaaaatgccagtatctgtaaactgcccatccaagacctgcggcacatcccgcacacaatgacagataagtggaggcatactgaagtatctcaaaaatattccgggaaccggagaaaatgcgccccgttatatacatggtccccacacttacaaccacgagtatactgataggcataaccagatcggaagcatgcttttcgtgggtgtcatctaacggcttaacgtctgactgaatggatgaagcatcattcattctgccaagattgatattccatatggcgctgatcaatacgacagccagcgaaaaaatcgcataaaaattataaggaatcgtccctataaactggtttaacggtgccgctgtccccggcaatataacagcaaacaatgcaataatataggctccccagctggacagcggacagatcgaacacaccggcgcgctggtagagtcaataatatacgccagtttttccctggagaccttatagcggtcggtcagacttctggagacctcccccacagtcagtgcattaaaataatcatcaatgaatatgataattcccagcacaaccgctaaaagttgggccatagctgcatttttcactcgcttttgagcccacctcgcgaaaccgatggtcccgccatttttatcaatgtatgccgtaagcataccaagtcccagaataaagagcaccaacagtatattatctgtattccagtttccagccgtatagaaaatgcgtgatgccgaacccaccacagcctcaaccgtttcccccggctgaaagttacacagaataaacgcgccggcaataataccggcagatatggaaatgaccacccttctggtcgcaataaccagcaatataacaatcaggggaggaatcagagaaatcgcagttgcctccataatgatccgcctttcctttcaatgaatgtaatccatctttctattccgccgcgcttaacggcagctttccttcagaatcatcttcccgccgtcgatcactcttgagccctccagcacccggtcctctctttcccatacaagcggttttatgaaaaatgataccttttcactaataaactcggaagcactcctgtaaaacaggcttggggaatggtccaggcagtaatgcgcaacgccctcctccctatagatgggattatccgttgtcgtcgggtgggaagtctcaatggcgccatgttcatcgcagcttacatcaatcaaaagtgcatctttttttagtttttttaagtcttccctgaacaggatatgatccctgcgttccgggtcccacaacacagcatttacgatgatatcaaactgttccatttctttcctgaactgttgttcctgtctgcgtccgtacacagtagtcaatgcagcatttgagacaagcatcttatacgctcccatggctgtattgccccgtcccagtatagcggccctttttccttccatcaggattccatagcttaaacagccatggaggaccgatgcctcgcctgcaagaatactatttctgtaaaaaatctgggtactgttctccagcatctcttcccaggcatatacccttagcttcctgtccagcagaagtttcttcatatcgggatccacatgagggtgaacccacccgaaaattgtggttccttccctaagttcacccagatattccgcatccccggccttgagatcacagataatatcacatttttgcagaatttcctctctggtagaaattgaggctcccattttctcatactcctgatcgggtattcccaacttacttgcatagccccgctcaaagaacatgtatgcggcttcctttcccagctcattcatatggcagggaagaagtgcaatcctgttttcattttccttatggctgtttataaaacccattgtcttcatgattggaacctccttacagtacctcttcgtttttgtaaaatagccgaattacactgctgctgagcagtgcaatgcgattcgatgaagcttaccattgttttcccctttctggctgcctacattctacatcatggcagaataaagattccatgtaggagaatctccgggatgtaatcattctataaatattcgtgtgtttactgtacttttcatactacggcagtcaatgcctgaatcaatatcaaaattatccgtgcgaatattccagccccttgttccactcctctcctattcattacatttccgcaccctttcacggcatattctttacatacagcccttccttatgttaaaactatgacaggactgtatgataaatataaggaaagggcagttttccatgaagcaaatattacttgtcgatcctggacgtgaatcttccagacagcaccggcggggagatctgtcaggaaatacagaaaaaatccgattctgcgattatctttattacagcaaatgacctggagcaggacatcttaaaaggaaactatgtggtatttcacctggcggctgggggctggggaatcggcagataaatataaaaaaacgaaatggattatggaggaaatcaaatgtatgaaaactggaaaagaaataacaaaaaaatgattatgctgatgatcttaaccttggccattggagccgctttgtttatcattttctgcttagatttatttggcttcgcccaattattggtgaaaggaagcagcataacctccgaagacatgaaattgtatggggaaatcttcagcgctattattttaatcctttcatctgctgcactgtgctgcaagattaaggaggaccctgaaaaaatatttgtaaaaagccttagaagatatgccaacaccacacagcagccggattccacggtggagcggctcaaaaaaacctgggaaagcggtgaaaagctgcgagactggtgccgtatggatgagaaatatatcatcgaatgtatcaatggcccctgttatgcaaatgtgataccgattcaagaggtggtttgggcacataaaacagtaacacaggtaaatgccgtcataaaaacaaatacctccttgattttgcactatgcaaaccataaaggaggtaccatctccataagcgaaacggcagtagattatattttacagcagtttatggaaaagcaccgcgaaattgtcgtgggatacaatcgggaagtggaaaaactctacttaaaaggggatatggcgggtctcaaagaatatgcccgtcagcagcgtactggcacacccgcagactgatttggtttgccagtagtaagattaaggagttgtatctaaacagaaaaaaatcacctcattaattgcctgactcataccagaaataatttgattaattttttcaggaattgcattcgaatcattatgtgcaagtatgtttctaagataggtaatatcatcttcgctaaatgttttcccggggcgtcgagtctgatgaaagccaattgtatgagtaggatcggatggattaaatatatgattaatatagtccgttacgtccttctgcctgtgcttggccgataccaatgacataagaaactcgtattgtatcaggtaacgaattgctatattctcgatcttcattatgctgctgaataccaggagtctgtctctcttttcagaatcggaggggatgccagagaatattttggaaaattgctcaattgaatatatgggaattgccaaagtactgcattcaataccaatggttgttcttgcagtgaaaatcccatctttattcacttcgtttggattgtagatttgattttcctgaattgtaaatttgtcaaccactgcattcaattttccgatgatatttattaaaaacaactccaccaactgataagcgttctctttcatcacctgatcaatgaatgtatcttcggaaaaccatacttttattccctctaaacaatattttttcatcaaaacatcgattgaaacaatagaaccctggttttcaacaggaaatgaatgattctcaccgctaatggcaatgttttttatgcctgtaatataaaacaaaatatatggattcaagataaacacctcctcatagctggttaccctcttccgtattatattaattcatattgtacaaaaatacaatgatatttattcatgttctgccatctgataatcctgaacatcatccataatattattttctccataaattatacccaggttcaaaaagtttcgaacctgggtatgcctatccataaagaccccaaacttgccccatgcctgtcctcacaataaagggcagaacgacaaaaaaacggattctcatgactatggagaattgtacctcaaagccagaagttttaatgtaataatgattcttctttcccgatcagctctcctgtatttttctattcggtgcatctgtcaacggcacggtcatccagttacggattatacaaaatcatatgcaaaatcacctgttcatctccaatattcttataggaatgtacggtatcggccttaaagcggatgctttcgcctttctcaacttcaaacttatgaccatcggcacaaatttcaattttccccgcaaagatcgtgataaattcggttgttccctttagatgaggttccgactcccaataactctccctgtccagctccagataatacacggcaaatctccggttctcatcgtctggaaaaagagagtaatttttcacctttccgccgtcttccagcagcggctgaatctctgaggttttcacaatttcataaagactcttgggacggactgtcagggcgtcaaaaggcaccttcattccatttgaaattttccatagtgtagatatcgtcggatttccatctccgcgctcaatctgagcaagcatactcttgctgacgccgctaagctttgcaagctcatccatacttaatttgttttcttcccgcagccttttcatatttttagcaacgattgtattcatcgaatccaaaaatatcgctcctttctattgacaatatatcgcacaagatgtactattatatcacactagtgcaatatattaatcattttgtatcattatactattttactatcagtttgtaaataggaaaggaatcattctaattatgaaacgagaacatttctcatcgcgtctgggatttattttaatcacagcggcctgctctatcggtcttggaaatatctggcgttttccttatattacaggaaagtatggaggggcatcctttgttatcatttatttgattttcctggtcatactgggcctgccggttgtcgtaatggaatttgcggtaggcagagccagtcagcgcagtaccgcgcagtccttcaatattctggaacccaagggcacaaaatggcacttatttaagtatgcaaccatcattggaaactatctgctcatgatgttttatacggtaatcagcggctggctgctctattactttttcaagatggtgaagggggattttcagggactcacctcagatgagattggccatgtattctccaatttactaagcagcccgctatccatgattctctgttccttttttgtaattgttctctcgttcggtatttgcgctgtcggtctgcaaaagggagtggagcgtgtcacaaaaatcatgatgtcgcttcttttttgtcttctgctcattctggccgtcaagtccgtcatgcttcccaatgcggaaacagggctgcgttattacctgtatcctgactttggaaccatacagagaattggagtacaggaatgtatctttgcagctatggggcaggcgttttttacactcagcatcggaatcggcacactgtccgtatttggaagccgcatcgacaagagccattccctaaccagcgatgccctttacatggggatcctggacaccgcggtcgcacttctggcggggttgattatctttccggcctgcttcagctttggggtagcgccggacagcggaccaaatctcctgttcattaccctgccgaatatttttaatgtcatgagcggcggtcgtctctggggcagcctctttttcctcttcatggtgtttgctgccatttccaccgttatcgcggtgatcgaaaatattgttacttacgggatggatctgaccggatgcagccgaaaaaaatcagtttctgtcaaccttatactgcttctgctgctgtccctgccatgcattttcggtttcaacatctggaaaggctttcagccgctgggggagggaaccagtattcttgatttggaggatttcattttaagcaataacctgcttccactgggaagtctggtattccttttgttctgcacccggcgttatggctggggctggaatcaatttttcaaagaagcctccattggaaaaggcctgccataccctggctttgccaggaaatacataagctgcgtcctgccggttattgtgcttgtgattttcataagcggctatttatcactattcaaataggctctaaaagaaagaagggatgagatgttccatttatatgattttctaatctactgttttataaccgcctatacgccgggtgccaacaatctgctttccatgagcaacgccatacggctgggatttcgccggagcattcggtttaatctcggtatactggccggattcagcgtagtcatggctgtctgtactgcattcagtgcaacgctctattcgtatctccccagagtaaaaacaggcatgcagattctgggcgccgcttatatgctgtatctcgcatggaaggtctggaaaagttctgcggatttacatacagacggcggaaaggaggccagttttatttccggcatgatactgcaatttgccaatcctaaaatctatatctatgcaatcacggctatgtcgctctatatcctgccagtctgtcattcgatccagggattgaccggatttacgattctgttttccctcatcggcgcctccggatcttttgtatgggcactgtttggagccgcattctgtaagttcttctcgaaacacacaaggctggtaaatacagttatggcaattttactcgtctactgtgcagcttccctgtttcataacggttgaaaaagaagcgaaagacctcaggtttttcgcttcttccttttttcaatattttctattatcagtggaatacaggcatgattgcggtattctcaaagaagttctaatcttcccaaaatcttattcgtgcagtttactgttcttccatcctgtctcaatcgccgcattacaatccgcatcaagcgcctcggctgcctcctcgggcgttatggtcccggcaagcagcttgtggatatgcgtgtagaatacgtcgcgcacaccgcgccagtttgggttgttggcggtgaaatccaccgtgttggctgtgttcgcagtataggcctcctgcataaaaatgtgcttgctcacacgttctgcagtggcgttgctggcagggattccaatctgtgcgtaattcatgagttcctcatcagacatgaaataacgcaggaaatccttggcggcctggaccttgtccgtgtcgccattgtcaaaaatctcgaagccggtgacaaacgatgtattatatcctttcccatccggactggggaaattggccgttcctgtcaagctcatgtccatactgggcagcgtggcgctgtttgccatgtatatggcaagctggttattggtaaacagatcgctgcagtcaacaatctccagattctcacagccggctggaaaatagccctttttataggaatccgcaatccactgcaggacggcaattccctcttccgtattgagattaaaacggccattttcgtcaaagatatgactacccttgctgcgcagtaaagtcatgatatgcgtgtctccctggtcgttcttggcgtacatcagcatgggataggtcatatcaggcagattagcagccaatgtggacaggatgtgctcccattcctccggcgaccagctctgtatcgcgccatccactccaatatactccgccagtccgcattgacggaacagatccttgttataaatcagcgtattttgaaggctgtaatagggcagcatatacgtcttaccgtctgcctggctcatcttccagagcgcatcatcaacatctgcccgcatttcctccgtgataatgtcgtccagcggcaccacgcggcccgtatgaatatatcctgccatgttaaaatagccttcaagcagaatgtccactgcatcatccgtatcaaagcagccggtaatatattcatcctcctccgtgtagccgaactttacaacctccactttgacatcgtaatctgtgtactgggcggcgaatgcctcgcctgccctgtttaatacttcataggaatcagtaatgcccgtgtcggcattggccaccgtcagtggcggaagctttactttcagtgtaatctgcctcttttctgcctcctgtgttttgcaaccggtaagtatccccataagcataacaaagagtattccccccgcggcaatccgtctccaatgtttcatctcttctcccctctttttcctaatccaagcttctgcatcagcttgtttacgtcgattggttttgcaatgaagccgtccattccaatttccctcgccttgacctgatcttctctaaatgtattggctgtacaggcataaataataactgtctttgcgtctggacgatttagcctgcggatgagctttgtcgcctcatagccgtttcgcacaggcatttgcacatccatcaggataatatcaaactcatacggctgggatttttcaaacagttcaactgcctcgcccccatccgaagcccggactgcggtaaatccagacgtatccaggatttccataaggatttccgcatttaaatcattatcctcagctaccagaatatgtggttttttctctctttcctggtcttgatgtgcgtgatccgccacagcagtaccagcaaaatcttcaggggcagtctctgacatcaaagtaaaggtaaagcagcttccttcgccaggccggcttgacacggccagtgttcctcccatttgcttcgccagcagcgaactgatggacatgccaagaccagtcccctgtctgccctgggaaataccactgcgttcctggctaaacggatcaaatatcttttgctggaactcttcgctcatgccgcagccggtgtcttctacctgataggtcgtcaatattcctccggcttccgctgactggaatacccgcatagtaacacggccgccctccggtgtaaatttaaccgcatttcccagaatattgacgaggatctgttcaatccttatatcgtctccaacaaggccggaacagataatgtcggtttctacccggaagtcaatccccttatcttccataggactgcgcatcagggattccgtcgtagaaaccagctctttaacagaaaacggctttggcaccaataccattttgtcagattgaagttttgacatatccagaatgtcgttgacaagtgagagcaggtatttcgcagttgaatcaatttttctaagatatcctgtcatccgttcagtatccccaatgttctgctgcatcagatggatcagaccgatgattccgttgagcggcgtgcggatctcgtggctcatattcgaaagaaactccccacgggattttgcttccgctcttgccgtcgcggaaatcagggagatacggacaataacaaacatcattaagcacagtaccatcacaacgactacaagcatcaccactgtcatgagtataaactgctgagtctgttcacggaacacttcctgaggaaccgtcagtacgatactccatgtcgtaccgggcattgggataaaggataccacctgcgctccctgatcaatataatcgaagtgcagcaggaactcctctccctgccctattcgggtgataatatctgaaacttcctttttcgatagaccagcacgattctgcagctgttcaaaatagttgtctattttccctattcctgcgctgcggtcccggttgacaacgtaatttccgtctatgtcaatgattccggtatatccccgcccatcaaagctgtctattttcaggcgatcctccatcaggctgatctttgaaaagccgatgatccctataaactgtgtcccatccacctcaaagggctctccccgaactccatagacgagactttctgtgagcgtttccaaaatgtccatattgtcatagcgcatgacaattttatcttgatcgaaaagcagaggcgacacgaactctttttccttttcattttttatcacattcgagctggagtaggtgtttccatcagaatctaccaaataaattgtattaaatatatttgaaatctgctctaaatttaaacgtctgcaaacatcctgtatactcgcgcattggctagtcatcgttctggtgtagaccgcagacagggagtcccacgaattttccaattcgctttgaatattctgcatatcgtgcctggataattcctgcatcgaagcgacaaccgaagcatccgttgttttggtaagttgtttcatgtagacacagaccgcaagcgataaaacgaccaatgtcgctataataaaagctatcgcccggttcttgttacctcttttcataacctcctccattcccctgaaatgctccgtcagcccagatacacttcatcgtatttcttcagcccgtcatatggggaaaagaaacggtttattcatacagttcaaactggcttaccaactcttccagtacctgcgcctgtgaggaaagttcttcactggcagcagccaattcttctgaagttgcggtgttgctctgcactacatccgatatctgtcccacttctgttgtaatatgtgaaatagcttccctttgataatttgctgcggctgctatcttgtccactgtcattaccacctgctttgtactttccacgacctgcatcagtgaaccagctgcttcgcaggctgttttttctccttcttcaaccgcagctgctgattccttaattaataccgttgtatttttagatgctttcgatgtccggtccgccagatcgcgaatttctcttgcaacaactgcaaatcccgccccagcctcacctgcccttgcagcttccaccgaagcatttaaagccagaatatttgtttgaaatgcaatgtcctcaattgtctttatgatatgatgaatctgactggacttttcgctgattacattcatggcttcaatcatttcctgcatctttttactgctcatggaaacctgtacacctgcctgttccgtctggacacgcgcaccgcttgcattttccgctgtttcgcttacacgatcagatacattatgtacgactgctgcaagttcttccaccgaaccggcctgctctgccgccccctgggcaagtgcctgagctcccgtagatacctgtttgcttccatctgctacctgttttgccgaatggcccatctgcaaaaggatacggttaaggttatcgcgaagccccttcatggaaactaagatacggttatattgccctctgtagtattctttcacttttgattggacattaaaatccccttccgccatggagccaagtataccactgatatcctcaatgatcgtcttctgatagctgatcagatcgcgtatgctgtccgacatcttccccagttcgtcttctgaagtataggcaacaaatgctccatccaactctcccacggccagcttttgggcagcaagctcgatttcatttacaggcctgcgtataccattggaaatataaagtccaaacaataatgctgacacgatacttaaaaccatgattataatcactatgacaattgcagcggtctgcgcgtgctccccctccgccaccataagctttgcattctggccagctgcatctgctatcatctgaagagtatccgacatctggttcagaagcggaatataatttaatttcatcacctgataggcttccgcacgtttctctgaatcaatcagttcaaatacccggtcacgatatacgacagcctgctctaacagcgaatcaacctgatccacgagtgcgacatctcccttgaatgactttcggattacagggaaggccgcacgcatatttccaagatggctgtttgcttttgctacgttttcgttcgtatcgtccatgtccaaatctaatatggcattcagaatatctgaccgcgcagcctgcatctcccgcttcgcgatccacacgttaaccgtagcggtataattattgttgtagaaggaagacaggttattaccgattttattcagcataaacagcgccgcgatacttgccgccaggcatataacgataatcactgcatacgataataacagcctggcccttaatttcatattccgtatatgttccagcataattccctcctggtgatcattttgtttcactccaaagtatcccgctctgcagccacggcgtcccgtgaggcattccacaaagggaactttttatagaagtaattcagcctctcctctataaacgactgccacaggtctgcaaataatcctgaattgtcagcttgcaaagcattttctaactggcagatgaaatcatgcaaatgaacttctggctgtccggttcccatcaggacagcagaaaaaatgtacccccatgccacaagttccctcaatttttcatagatttcccgtatcgatgctgaggggcattcactggagatgaaattcataagaacatcaatgcaaagtatgctgttgtttttatcacgcagcatacttatggtttgcagcagtttctccttcctctctctcttagccgattccaatgtatagtgagtcacgctgcgaaccgtcaaagccagtatttgcatagcctcgccatgaaggcgcaggttttcccggatttcagacctgcccataatatccatatcaacggattccagacagacctttgttccaactcccatataagtcttagttatcccaagtgaattcagtacctccagagttcggcgtactgtaatcaaagaaacgtcataccgctccgccatcctgggcagtgagggcagatagctgccaaccgggtaaacctcccatagaatctcacggattatggtggaggccagcgtataacgcatctgcggccgctgccggtaaatcgcccatgtaaacggaatctgagcctcatgctccagatgatacgtttcacgattcgtctcaataaaatccagaatacccaaatagatgtttaaataataggcatctgtttcctgtttcaggcgttttgccttctccacggataacaaatcttccgctgcataattcgccttcctgtcatttctcgggggatagaaatagctgatataacgcatgctttgccaaaaaaggccaagcattaattcattatgaaatgtattcagaacgtcaatatacagcccgattggctctgatgcggctttccccaccggatccgcctcaccggttggattttgcatacccagctttatattctgtatacccttttcccatattgatgaaaacatgagattaccactaaattgaatgtccagaattccctccctgcgcagagcaaaataccttacaacattttctctgaacagttcctccgatccctgataagcaaccctggccactttccgtttttctgtttttatatagccatccttttccagcctgttaaacgcaatttgtacggtattcctggccagccggaatgaggcacaaatttgggggactgacttcaattgttcaccgtacctgtatataccaaagaggatacgcgatttgtagtattcgtaaatcagttcattcagctcattgtttttttccatccctgtcctccagtataaaataacttcttaaaaggccgaaatctgctccaaagctttaccctgctcatgttgggtatagttttattgtatcactctttgcgtatgcatgcaatgtaaatacgaatatcatttgattatctatgcgaatctggtatattttccttgttcatggcagcaaaagagctgcctgtcttataggttcctataaaacagacagctttatgctcattgctgtagaatatattaggaggctctcctgttcatcgtcccacgcctgaagatccaactgttcttcagccttttccaccgctccaaaaggtgctctgcggccccttttaatttttttcaaacagaccagtcatgtcttccgcccagctgtaatcacagagataatcgtggtggtaactgttgacagcgcggggatcaccatccagaaattgatagctgtcacagtcaaaccgggtaatatcaacggcaaggctgttgcggctgtgcactatgatatcctcaatccctgctctgcttaaggtcatgcgtaaatccaggagtaccacctgatagtaatttttctgcttcctgttatatgggttatcttcccacagcaaggcgcatgcctgcggagtcgtaaccgcattgccatgccgctttaccagataagccaaaagttcttttgattttgctcgggaaaagacaagggggattccgtctacaaaaacctgaaatccgccaaaggtctgtacctgaattctcttttgtacagctctgctgccgtaaaggaaagtcaactcccgcaatatatcggctgtgagagcgggtttcatcagataccccgtggcatgaagctggatggcctcatatgcgtactgctggaaactggtcacaaaaataatatggatatctggttgtatatctttaagatcctttgccaaaacaagacctgtcgaatgccccagttcgatatccaaaaaagccgcatcaacagccgcataccgcacatattccaatgtttcactcactttggaaaaagccgccacttcacatccgggcactgcctcccgaagcgcatcaactatatccttaagcgccataggctcatcatccaccgctaaaaagcgcatgatacttctcctccctttaaatggtaaaagtcaccgtagttcctgttccaggaatactttctatctttaatgtccctccgcacatcgtctgcagcctgttttgtacattggcaatccccatatgagacctgtcaccagacaagggagcttcggtgtcgaaaccgattccatcatcatgtatcgtcacaatataggaaaactctgtttcactggtacagatgaccactgtaccgccctcttcacgcatcataattccatgccgcaccgcattttccacaatgggctgcagcgtcagcgggggaattgcaaaattttccgtccgaatgtcatagacaacattcaaccgttcctgaaaccgctgcttttccagattgagataatgcttcacgtgagtcagttcctgggcaaagggaatcggcgatttattggtcagagaactcatattagcgcgcaaaaaatgtgagaaatcccttatagcttccttggcagccattgggtccgcttcacagagctgtcgtattgtcgtcaaagtattataaagaaaatgaggctggatctgacttagcatgatatctattcgggatgctgccagctctgcttcctgccggctgatgaccagttccctctccagctgtatattgataaaaacaagcaaaagcaccagtgtagtgcctgtattcatcagtgcaataccgtaattcatcatctgcactgcttcggaaatcaaaagtacggccacataggacagcagaaatgatacgtcctttttctgcataaaacgtctgtaccgcaagatcatcgctacattaatggtatagatgaaaaatggaatcagctgggacagccagaacccgtttcccctcatatagtaattgtcctgggtaaatgtaaagtaagttccggtccataaagacagcacactgaatgacaactgtacgccagtaagagcacaggccagattccacacccatttgggaacaacgactctcggcgacagatactcaataatataggctgcaaaaaccagcagcagtggtgcggagcagccataataaataaccgttcctgcccgcaaagcaaaaggaaaccatggctggacaaggctttcacacgtccagttcgttaaatctcccagcagcattccgaaattgaacacgcacataagtgtaaaatggcggttctgaaccaggcctgtgcagagcttgataagcttttgaacatactgattcataaaaagaatccgtctcctgtcatggtgtgttcccagctcgtctatcagtgttatctcgattgtggagatgactacaaaattaaactggaggatgaactgcttcagtcagtttgcatgaataagatccggctggctgatctcgtaaataatccggcttttctgtctgcaggagatgacagtgatatgtctcccaagccttatttcaatctggaaaatgcggctcatgatctgttttacgccatggaggaatcagactgtttttatgatacctgcctcttaacagcggacgagttaaattctactctaaatcgtgtaaagagatttctcgacacaattgaacatattttagaatgcgcaggtatcgacgtagaagttccggctttatttatagcgccaagtgatttactatatcatgcagtaaacttaaagcaatatgacacggtgtatatttccaggaaatagaactaacacatcgaatgcaagtatctctctttcttttgttcccgtctgtagagtattacaataaacaacacccctattacatccgtgattgcctgcgctccatagattgccagcaaacggtaaaccggttttaccaatatcggaagaatcaaaagaaatggtatatacaaacatttactgaacgctgatacaagcagggattgttttttcattcctctggcaataaaggactgaatcagagtagactgaacaccggaaaacaacatgccaaaaacataaatacgaatcagatttctggagacggcgatcacctccccgctctctgtaaacatccgggaaaagcttccgggtacagccatcagaaataaccaaagaaccgcagcgtaagcggtcgtaataagaatagaacacttaatggcctgccggacccgctcttgcttccccgcaccgtaattatagcttatgaccggctgcaggccctggcaaaagccattgaccggctgccttataaaggacgaggtcgcagtgacaatcgttccaaccgagatcgcaagcgtcgcaccatcaatggcatacccggtaagcgcagccgcaccatattttctcagagaatgatttaaaataatattgacaagactttctgctccggttgtaataaaattagaaatccctaatgtcacaatactgccaagcgtctgtttatcaggaatcaggctgcattttctcaggcgaatcatcgaatgtgaggatatcagatagccgatcacccaggctgcggataccgcctgacctgctacggtagcccacgcagctccagcgactcccatatccaggatcagaataaacacggcatctaatacaatattaatcaccgcaccgattataacggaaatcataccaacaagtgttttcccctgggtattgataaaaatattcatacccgttatcaccatggaaaagggaatcccaaggcagataatcttgacatattggaccgcatagggaaggtttgccccggtcgcgccaaaccagggtaaaatctgttttccaaacaaaaacagacacaaaccaaaggccaggcccgacataatcagaggaagaaaacagcagccaagatatttttctgcctttttcctgtctccggcccccagggcaatggcagcctggggcgctccccctcctccaaacagcaggctgactgccataaatataatattaatcggcagatagatcccgatgccgcccagggcgactgctccaatttccggtatccttcccacgaaaatccggtcaacaatattgtagagcatgctgacaaactgtgcgacaaccatggggattgcagtctgtaccaccagttttctgatattgccttgtgataaatccatattcttcatatccatacccttttatattctttgatttattatacgttcgccttttacttcatcagttcatccgtaagctccataatcttaggcgccagcttctcccgctgctttttcgtaattctccggtacagaggaaatgtcaacccaattcctgccatacccaagattccgataccgatgccaggtataaacaaggtatctgcccagaccattgtgcagcacatgccgatgccaagaacaagtacgctgatcgttcctataaccagcgatactgccatccccttctttgaaacgctttcgtccagctttctcagctgctccatcttattttcttccggccgaagatatttctggcgtatttttttaatttcctcctgttctccagcggagtaagtatacgtaaattttttttcgttctcttccataaaaatcaacctccagtcctgtatagtaatcattttccgggaaccagatgctgtctcggttcctcagccagaactcttttcagccgcacggtgaatgtgctgccctctcccagccggctctctatagatatatcgcctccaacaatatccaccactctttttaccagtgcaagccccaggccatttccctgtgtagcatgggaactgtccccctggtagaacttttcaaaaatgcgttttcccacctcgctgctgattccgcagcctgtatctgatatttttatcaccgccattgtctcatctgttttcaagctgaccgtgatttttccgccctgcggtgtaaatttaatcgcattcgacaaaagattattccagaccagctcaagcagctccctgtcggattttacctttacccgttcctctaaatcaatctccgcctccagatcttttcgttccagcacatcatcgagacgtatgatacactccgacagctgcgtatccatatcgaactcttttgactccggaaaaatctgctgattttccagcttattaagctttaaaatgttggtgatgagcccggtcagtctacggcatgcatccacaatggcctctgtatactcttcctttttatcttctgaaagctctgcattttgcagtaatgaggcgtaattttgaatgactgacagcggagtctttatttcatgggatacattggagacgaaatccgtacgaagcgtttccactccggacagttcttcagcaatacgattaaaattttcaattaaaacatccagttcattggtattgtcaaagtcgtgggcaaggggaacccggacggagaagtcacctgctatcagcttctgagaagcttttaagatacgtttcatcggatactcaagcgttattttacgataaatcccatctaaaaccgtcataatcaggctaatcagcagtacgttcatggctgtcaatttggcgctttcccggacacttccatagtccagttcaagatggttcaaaaatagcagcagacagcaggtgatggcagacgtgataatcaggaaatagaaaatatatgactttatggaaaacaagcttcttttatagcttaactcggcaggccgttctctcattgcagcaccgccttatatccaagtccacggaccgttttcagcataaagccgtcacatgcggaaaacttttttcgaattcccgtaatatatacatcaaccgcccgcagcccaatgtcgctctccaatccccagaactcatccatcagctgtcctctggaaaatgtcttattgggataagacagcagtttgtacagaatgttgaactcccttgtcgtaaccggaagctccgttccgtctacaactgctgtcactgcatccgcatccatggtcaggttgccaatggttatctttctttccacctctatattggcccggcggagcagggcgcgcacacgcagcagcagttcctcgacctcaatgggctttaccatataatcatcaatcccaaactgaaatcctttttgtttggagcttaagtcgtccttagcagacataaacaggatcggaatcgtcttatttacctgacggatagtccgggcaaattcaaaaccgtcaatctccggcatcataatatccgatataatcagatcatactgagtattatacatttcattgtaagcatcctgggcgtttaaacatcccttagccataaaaccactgttatttaaataggagcatacaaagcgattcagttcagaatcatcctccacgattaagatatggaccatagcggcatctccttccatcttgtatagacatcatttctacctagagtataccataccttttgtttgagaattgttaaaattaatcccccaaaactcctctgtaagcgcctcgatataggtatgctggtatttcttccccgcctgctttataaatgtcccgttttccggttgataaagcacataattcttcccttccagtaaaaacagatattcctgatccgatttaaaatatgccggttctatcctggaccctcactgtaaccgggctgctggttttccctccattcttattttctgagatttctcacttgatggctgaattgtatcgcatgattgttctcgaaatgatagagaattgttcgagaattataacacgtaatttttaattaacgcggccgtacaaaacgacggtccaggaaaaaaagattgtcgatttatgcggccgattttactttctaaaaataaggaaacgaattatagtgtttacaggaataaagtattaaggaggtttttccatatgaatgaagctgaaaaactacgatttatggaaatggagtatttaaagattttagatgaaaatgaaaaactacataagataattgtgcagttaaaccaaacgttgaatcgtttgattagatattatataagccgggacaaggcagcgtagacagagaaagaggctatcctggggctgtaaaaatgtttttttacagccctgatcctttcctgcctctcattaaactattcttccggaagtgcccccacaactttatgtctcatatacaattcttccagataagatacatcctcatctgtaatggtaaagtcaacagcttttaccgcgtcatcaaaatgcggaacactggtagctcctacgattggcgccgtcacaccttttttatattgccatgcaagggcaatctgcgtcatagaaacgccatatttctgagcaagctgatccactctttcgataatcaggagatcctgatccatggcctggtcatattttttgcgcagtgtccggtccgtctggctgcgttttgattcagtggtccagccagtatgcgccaggtgcccgcccgcgagcgggctatatggaattcttgccacatggtactgctcacagatcggaattaactctctttcatcctcccggtataaaaggttatagtgattctgcatcgttgaaaaaagtgtccacccatttttctcagctgttacctgcatgttatggaactggtagccatacatggctgacgccccgattgcgcggacttttcccgcctttattaacgcgtccagggcctccatagtctcttcaacaggtgtatcataatcaaatcgatgaatctgataaagatccagataatcggtatcaagccgctttaaggttccatcaatctctctggtaatcgcttcttttgacagctttccttcattaaaataaactttagaagccagaactacatgctctctttttacacccagttccttcagcgcacagccaatatattcctcgctggtaccatgggaataagtattggccgtatcaataaaattgacgccaagctccagggcatggccaatcatcgctgttgtatgctcctgatctaatgtccatagatgaaaatcttcgcttgctctgccaaaggacattccacccacacagattcttgaaacctgtatacctgtatttcctaattctgcatatttcatttttaatatatacctcctgattacagtgactccctgatgattttttcaatatcttcttccgtcagcggaacgtaggcctggtccagcccttcattaaccgctatatgatgcgccatttcggatactctgctttcatcaataccgacttcccttaagtgcatcggaataccgatggactcgaagaacctgtaagtctcttcaatcgccttttctgcaatctcccatttgtccagagacgcatcaatgccaaatacattgattccatatttcacaaatctgtctaacgttctgtcactgagaatatgtttcatccatctcggagtaataattgcaagcccttctccatgggtaatatcatagaatgcgcttaacgcatgttcgatcgcatggcatggccagcctgacgcactgttccccaatgcaagaatcccattgcagccataggtgcagtccagcatcagctcggctcttgctctgtaatcttccggattttccagagcaatccttgtgttatacataaggctcttcagctcagcttcacagaagccgtcatttaataatgttgtgtcttctgtaaaatactgctccatgacatggttcatggcatcggcacagccagccgcagtctgcttttttgatacggtaaaggtgtagcatggatccagaatggagcatacagggaatagatgcggatccatataccctattttgtcattagtctctgttctggagattacgccgccgcagtcgtactcactaccggtggcggccagtgtcagaatatccacgataggcagcgcttcctttgcaaatgcctgataagaaatcaggtcccatgtttctccctcatattttgcaccggctgcgatcgctttggagcagtcaagcacactgccgccgcccactgcaaggatgacgtcaatgtcattttccttacaaagccttactccgtccaatacactggtagaatatttgggattgggttcaataccggaaagctcgaatacctcaaactcttttaacagctcctttaccctgtcgtataacccaatctttttaatacttccgccgccataggtaagcagaatcttccttccaagcggcttcatcacctccggaagtttttctacaacaccttctccaaatataagccttgttggtgtctgataatcaaaattcctcatttttcttcctccattcttttcttcgcagctgcccggagcagctataatcattataaaacctggagtgaactccaagtcaagaagttttttcaaggaaccttgtaaaatgtaatattaaattcattttagcaagggtaaattcatctttaatgattttagtattgcacagtttgtggtatggtagagctggccagtggattcctcctatatcatggaggattattatgacagttatgaaaaatacttatgaccagaagatatcgccaatcttgatgacctatctctccattattaaagcagaggcggtccctggcacatatttacgcttttcatgggcatcaaatcccttgcagcagaaggactctctatcattacatcgaccaggggggtaccatcaaaaatattgatttaagacgcaggcgggctgatatcaaaatccttaatcgtttctccggatttgaccgtcacttcaaatattacggtatcctcaaatgcaagatgcgcataactgtatctgttatcaaagtactgaacaccatccacctctgtatcatctgcctttaaagcaaatgtatcgctgaatgcttcatagtcagcttttgtatacgcctttaatgcagcgttgcttgcagctgccttttgcagattaccggggggccctgcctgaatttgttaaagattctcctgctatggccggcagtggcggcattgccattgcaattatcaaacctgcttccagtatcctgttcattaactttttcatgtaaacctcctcactcttttttgatttattatagtgactttagttttcaatacgtatggaagaattttgtatcttgtatggaagaattttgtttcatctgctgattgttataacatcaaaaggggattcaataccgctttccttgttcagtcttctatgatagaatgaggaatggagaacctatcgacatagttgtagaaccagaaagcaggtgagactcatggatcaatcattattggaattaatgcatatatgtcccattttcagtgactttaaccgagaacagttagaatatctgattgggtgcaatgtgatgaagatcgctgcatataaacgaaacgatattgttttctggacgaatacaactccattgaaattatatcttctgatcagcggcggaattgctatggcaagagatacgcagagcggcaagcgcagtctgagcaaaaccaataatgttcccggtgacttaattggtaccgtgcggctattctccccctcaaaactgctgtgggactatgcggtagcgttagaagacagtcgtgtcattgaaattgacagcagcctttttgtacaaaaaggaattattgatatggatatacagttgctgcttttacacaatattattgggaatgtagtagaaaagattgactatctcggccagaaagtcagaattctatctaccgcatcagtcaggaaacgtatcgcatactatttgctgagcatacaggatgaaaaaggccatataacgttatcttcaaccagagaagaaattgcggattatctggacattgcaagaccgtctttgtcgcgggaactgggccggatgcaaaaagatggcatcatccgaatcgatggtcataaagtccaaatcacagatcaggatgcttttgatacattatttgattagaatgtaaccgtagttacatcatatttagccttcctttgatagacttagtacagaaaatatcaaaaggaggctttttctatgaaattgattgcaacagaagaacactatatgtccaaagctgtcaatgagcaatatatgaaggtgatgacgaaacttgtcagtccggcgattcgagccagactggaaggcttgcagcactttcttgaaagcaacagagaaatcagtgatttgggagaactgcgtcttgctgcaatggataaacagggcgtagatattcaggtaatctcctatggaaataacagtcctatggatttgccgcccgaaagtgctgttttgctttgcagacaggcgaatgatgaactcgcagccgcaattcagaaacatccaacacggtttgccggatttgcagtgttaccggtaggaaatccacaggcggcggccgaggaactgacccgtgcagtaaaggaactgggatttgtgggtgcctccttgaatggggtgtatcgcggacgtttttttgacgaaccagaatactttccaatttttgaaaaggcagcacagctaaatgtaccagtctattttcatcccggttttccagatgaaaaagtgtctgactattattacagaggagaaaacatttcggcagatgtatcagcggtattttccgcttacggatatggctggcatgtagacgcaggaattcatatgataaggatgcttttgtctggaattttcgagaggctgccagacctgaaagtaataaccggacattggggggaattggttccctattattttaaccgtttagatgactattttttcaaatccataactggttttgaccggaaattttcagatatatataaggaacatgtttatattactcccagtggaatcatgagccgcagtacagccatgctggcgattgaagaaatgggggcagaccacgtgctgtggtcgtgtgactttccttatgtaagacgtgaggatggaaaggattttctgatggaactggatttgagtgaggacgcaagagaaaaaattgcttataaaaatgcggaaacgctgctgtttaagaatgcgccaggaggaaattgagcagaacactgctaatctctggtgctataatcaaaaatataaaaactgtgaggtatacaaaatggataatataacagaaaaaattggtcttggatgtatgggaatgtcagtcagaagaaatccagaagattccattaaaacgatccatgcagcgctggacgaaggaattacactatttaatactggtgaattctatggaatgggggaaagtgaaatgattgttggccaggcactaaaaggtgtttcaaaggataagtatttcctgtcggtcaaattcggcatgctgtctgatccatcagggcgtatgtacggcatggatacaagtacttttcatatcaaggctcgtcttgcctattctatgagacgtctgggagtagactacattgacctttaccagcctgcccgctttgatgagacaattccggttgaggaaaccgtcggcgctttagcggaactggtgaaggagggatatatcggccacattgggctatctgaagtagatgccgatacactgaaacgtgcatcaatggtacatccaatccatacggtggaagtagagtattccataatcgaccgggatattgaaaaagatttaattccagcagcccgggatctgggtgtgaatttactgacctttggccttttatcacatgggcttttgagtgataccgtcattgatggaacttcacagccctccataaaatttggccgttttgctccggaaaatctcagtaaaaaccagatagttctggaacaattaaaaaacttcgcctatgaaaaaaatgtgaccgttgctcagcttgcctatgcttgggcattttcaaaaaatccagaaatgcagtgtctggttggaaccacaaagccagcccatttaaaaaatgcaatggaggcgctcgatatctctttgtcacatgaagatatagtgagaatggaacatataatttcagttgaaacgattgtaggaactggtatgcgtggcgtaagattttctggtggaaagcctgtttttagataaagggataacggaaaaagaagaacgcttccgggcttaagcctgaaagacgttcttctttttgggcataaacacactctctccccacaacagagtatttatccaaatccttcaacttctaattacgttatatcattgtataaaatattctcactttcgacgcaattcccacaacctttgcagtatccagaggttgtaatccgtataattggaaaacgcagttagaactcggcaagaagttgaattgttactatttatatttaaacacgctttgtcaatcacatcctatattcatatttttatacagtattttcttgtcccattgaaatttattttttcgacagcaagcaatatgtttccacatttgctgaggggataataatgatggcagaagggcgcaattctccccaagcggaaacaatataatcatctttatacctcactttgctccgcttgatgttctaattccagcaaatacttatcatagtctgacataaataatctatcctgaacaatacgatatttttcaaactcagtctctgcatgaagctttgcctgttctgcactgacttttcccgatcccatcagcagttcattcccgttaaattctagaaaaccattaagacgctttgcccagtcctccatactcattggtattcttcgttccgcctgtaactcagcatagtcgagatacagtgaaacgattctctgtaaataggacatttccttttcgctcagataattcttagcaacggtaacatctgctttgacaatttccccatgggataagttctccttcgttgtcttttctatagccatatgccgctgcgctgataagccatgttccattcagcatccgtttttggtttccccacctgatattttttgaaatggaagctgattcttcctctgcgacagaacaatagattgtcagggccaattgtactttagctaaaacatcaccggcataaagaacatatacggggctgtgcaaagagctataagtaaagcagttttctttttatttttctcttctaacaatgatgtattcaaacatattttcagattaaatacatatattaagattcccgagacagctaccgaaacgagtgttgcgaaaaacggaaatattccgcctaatggatttgtcattacagaacctctgtaaaaatccatatctgcaatcatttcaaattcaaactgtactgccgcgcctataagatccgccaaatatccaaacaaccatgttttccaaatggactttctgtaattaaataaaaccttttcttttccaaacagtttaaatcctaccaaaagcaccagactgtcaataatgaaattaacaggaagagatataaaccatagctgcgggaaaatatacaaaaataatggtgaaaacccaatattataaagcttagttccttttgatttcataaatattatcctctcgtctttatttatcacatctatctttgcaaaatgtttcgtaatactcattttttatgaaatactctgcatcagccaaatagtgatttagtgaacagacttaaactaggatttgtcattcaaaattattgtatataggaatcccaatgaccttaatatcccacccatcattgtatcctgtttcagaatctaaatctaattgatgataattcgtaacattgtacaagatagcactataacgaacactcccaccgtctttgtacatagttcgaataggcatcagcagcacaatcaaaacaacaatgatgatgataataacttttgtttttcttttcacgcgctcatctccattaattccagttttcctctccccacactgttttatatcaatttaaaccagagctaattcttccaaatcttctattgtaaaatgaaactgttacaaatgaaacaaaaacaatcacaacatcagctgccatggctcctttccaagtcatcgtcatggccgcaaaggtataggaagcggcattgaaaacggtatgaaacagcacacacataaagatactgctttttccagatattttacagattgctcctaagaaaaacctgagcgccacacattgaacggcaaacattcgaaagtcaatcagccctctccgtgattcgtccccggtatgaaaaaaagcgggatatgccatagactccaaataacccctgtaataacacatgagaatacataaccaaacttttgatcaagcgaaagaattccacctgatctttttcaaaaacattcacgtttctaaatgtcaaacaattaaccaattacccaaaagcaggcaaccatgctcctctgtcaaggtataacccgccctccagcgtactgcacctttcactttaagccgactcgtcaatcccccagcaaaaaccgcttctcctcatcctgtacaatctcccctgtttttctcccatatttcagccccttttcagcagccgctgctaacgccgtactgcttcgggcgtatcccatggtccggatcgtgctcttcataaggctctccttatcctgagcccccttttccttcagtgcgatgcagacagcattcttcagttcctgctggcagatctcgtccgccgatctcttatcgccggaattcatatcccttctgtaaactctgtattgatccggatcctgatctttgcgccagtagaacttcactctggcctgcttgttcattcgtgctgaaaccttcttaagcgctttatctgttgcttccaatgtctgtgggctggaccttgctatattgaatgcacgcagtgtttttttcaccagtcggtcatacataatcggagcttctgcatcaataatctgctgcattttatcggcgatcagcgccagactctccttctttatataatccgcggtagacagatccatcacttcaacatctgcaaaagtgtactcctctgcgcggtattccatctctgccggatccatttgtgtaattgattccacagcttcatttttacaagaagctaccttaccagccgctgcggcaggaaacggattctgagccgcataataccccatggctgcatggtctgtattctgcaccggagccacctcatctacaggtttctcctcgaccatttcctccatttcggtatttccctctgctgtcgctttctccgtctcagcctcacagactgtttccgtcggctccttcaccatttccgcaggttctttgttctccttcatggaatcatttgcgtgctgctgattcatcaggcgcgcctcttccttcttttcgccgaggctctgcatcagcttggcaagctctttctcccgattatcccaccaatccatcgtccaaatacggtgcagctcccagcccaggccgcttaaaacactgacctgagccacctcacgatccttggtattttgtgattggcgataggattctccatccaggatgattcccatcagatactcttccggattatagggattaatcacagcgatatccaccttaaattttgaatggcctaccgccttctggtactgatatccaccagccgtaactgcctggcagatatgctccataattccctgtgccttctccattctgttttccatataatccccctgcagtctgcccttttgtgcaaactccagaaagtccttaagcgcttctacccctttcgacttcgttctcttaagatcgatcatatctgcagtcatagcagtaaataccaccatctcggttctcgcacgggataccgctacattcagcctcttccagccgccctctttattcaacggtccaaaattcagcgacagcctgccttctgcatccggtccaaatgcgatggaaaacagaatgacatcgcgctcatctccctgaacattctccagattcttgacaaataatggttcttccccaacatttgcccacttatcaaaagcggcatccttctgatactcctcctgcagcagatcctcaatcaatgtttgctgactgatattaaacgtgaccacaccaactgtctgatctttcagttccggatcttcatatcttctgcgtatctccgcaacaatcgtcttggcttccgtctcattgacacgcccttttccgcgatcgaagaatccgtctgtcttaacgaggctcacgcgcctctccctgtcattcacggacgggaacgtaaacatcgaattctcatagaactcctgattgctgaaagcgatcaggctctcatggcggctgcggtagtgccagtgcaaatatgcagacggcatcccaagggccaggcagtcgtccagaatactgtccaaatcttcaatatccaggttatcttcatccaccgtattgcctgcaaagaagctggtaggcggcatctggttcggatcaccgacgatcaccgcattttttcctctggccagcacacccaccgctttacaggtgggcagctgtgaagcctcatcaaaaatcacaatatcgaacagatcattctctgccttcaaatactgagccgcagaaatcggactcatgagcatacaagggcacagccttgtcaacacattgggtatctgctcaaacagcgtcctgatggacaatcctctgccgttgctgctgattgctcttctcaacagattcagttctctgctgacttccacgctgtcgttagatgtgggcagctgatgtgtcagcttatagaacatctcatctttcgtcagattcatgaattcctgatccattttcttaaactgcgcaatcttttcattaaagccaattcccgtaaatccatttagtaccggttccttttcaatcacggacagaataatggccctgtagatcgagcgcagataaacggtcatgacttcgtcatgcggcaggccggcttcatacgcatcgcagatcggtcccagacctctctgcctgcactccgcggcatactgatgatatacgatccaatccttgatggaggcggcattttcgagtatgcagacgcacagcctcagcctgctttccagatagtttccctcaaaatggtcaaatgacagatccagaagttccgtcgtctcattctccgttttctttacggcatcctgctgcgcagccaaggcctttgccttttgaatacaggactccaaggttcctgcagattcaaactttcggatctgttccgaaaactgtgacataatctgcagctgactttttattcggtctttgtaagattgtaaagcgtccgctgtatcatagacttttaaaatctgcttccattcatatgacagttctgcctcagcagccgacatttcctgcacttcctgctgatagatggtaatgtctgtcaaataaaccgggatacgatccgtctctaccgcaaatgcagcaaatgcctgcagctccgccgtcagcgaagccagtgtcttccccttgccgaaaaatttcttattcgcctgatcatacttttcccgatacggcttcatatccatacgaaggaaattttcattccactttgaaggaaaatccgcctgcctgacagaaaatgcctgccgttttgtcaaataagtttcaggcatcacaaattctcgatccacattacttgactgacgtaagaacgcaggtatctcttccgccgcaatgacactctgtgcataattacagatgtctctatattcatcctccgtaacaggagccttaatctccatgagcgccgcaaaaccgttcacatctgcctgaaattttttaagcgcctctgcgtatgcgcgaataaccgattccaaatcaaacttcaatcgctgactatactccgtgttatgaatagccatgagcggatgatgatgcggatgtcccactccttttccggccgcgattaagcgttccagactataagcctggtgatccagatcactttcggtaagcgtccccacataggcatgatcaaaacggacgctcttattcagttcagggatcatttcataaatatccatcagctgacgaaggctctttccaaatggcctctccatgtgcaaagctttcacataagcatccagctccgcgcgcattttacggatatcctgaatctttttatcataatccgtcttcattccccagacgccgatctcaagccctcgcctcagctgatccaataccgccttcttcgttgctttattggaatgaagttccaggcaaaaatcctgaatacctaaagctgcaagtcttctctgaacgacttccagcgccgctattttctctgccacaaaaaggaccgtcttcccctttgtgagggcattggccaccattgctgtgattgtctgagattttcccgttccaggcggcccgtggagaacaaagctcaaatccgctgccgccatattgatggcacgaagctgcgaagaatccacggttaccggcaaataagcctcatccgtatccacaccatccggaatcgtacaatcccagtccaccgcacccgtcatcagactgtgaacgattttattgttttccaggaattcgctgttgttgtggatatcattccacatgacaaactgcgagaaggaaaaattaccgataaatccggcctctaccacatcccacatcggcaggttcatcacggcatgccgaataattgcgaacactttaggcaaatcaagtccatgcatatccataggcggcggattcagtccataaatcggcgtatcaaacttctgtttcaaaaattccagcagcgtgatattgatctgcgcatcttcatcacgcatgtgcatagcataccctttgctggcagatttccggataatgtcaattggaaccagcactatcggagcatatctggccgccgcactgttcttgctctcaaaccaccgaagcaatcccaatgccagatataaggtgcttgcgccattctcttccatagaagttttggctgatcggtacattttagtcaggcagctattcagctccttctccgtatagagggaatgcagccgtttatgcttacactccagtgcaatgaactctgcaaatggccccaattcgcttaagccttcaaccggaacaccgccctcccctgcaatcgacatttctgccggccgcggcataacctgaaattcttcaccatcagacagcgcatcctcgagaatacttacatctgaagacaaaagcggaacgaccgccttcgtcatacgcatattaatcagcatatttcgcagacttaaatccaacagcttgtgttcccactgcgtcagcttcgtgatctgttccttcttgctagattccggaatatcaaatatttcaactttcgtcttggaagcgtccgtaacgtctttttcgtttctttcctcatactgtacatcaaatccactggctgtctttacacgaaccggcagaggccgaattcccatgcttctggcgcgttttacatcgatgacaaaagcaaaacggccatagtccgagacatttcgttccgccatggttaccgcatcgtcaaagcttttactttttccggcacacatggccgtacattccaccacagccacctcgtagatccccttggacatccgcttttccaactgagagggatcatccatgatcatatcagaaaaagattcctcgatcagccagacacctgcgaagatatgtcccttcatcataaccatgatggggtttaaccccattgcttccaggcatgccacatacagcagcgtcatatccatacaggttcccaggtgctgttctaatacagcatccgccaaacggattctctgcccaaatgcttcaaagctggaaggcggttccgcatacgtaatattcttctgctgaatcgccgcataaaccgcggcagccatatttttaaccctattaggatctccaaactggtatcctgccagggacgggtcaccggtccatttctccagatacttcgccgcaagctggatcatactggtaacaaccgggtgatttggcatggcaaaagcagccagcagctccggcgtatactgcagaccaggccactgatcaaatgccagcactgtaatgcttactgtctctgaaatcaacagttcttcttcaaagtatatgcctgtcatcagctggcaggaactgcgttccgtaagagatgccagatattctgcattgatcagcacattcaagttcttaaaatgaagctcctcaccagattttatcttctcaatgcccagtttgaaatcctctgtaagcccattgctggaagtgattttaagcagcagatgattgaggttggtctccgaaccatttttaacccatatgtctctgacaatatggtcaccattatgtatgatggcaaagttaagcacgtcatcaatattgcaggttagctgcaggccatgatccgctggttttataacagtctggttttcttcctctgctggaacgggctcagcggtgactgtttttgaaataatcgattctgcggctgctgccgattcaccttcagtttttgccttcatacagttatcccatgccaacagaacggcagccatatgtttacagctgcttcccgcttttgcatacggacagccgcacttcatggaagaaaccgcatcaccgctcagtccaatttccacattatagttttctatgcctataactctcgctgtaatccgattttcttctattgctaaatcctgaaccgagtcgctccgggtataatcctccgccccatttaatatattttgtttaaaaagtgttctccactccaccttcaagcccccaatcgtaattacagcttatcgacaaatttgttataggctgccctaagctttttatttgcctgttcttcatcataagtaccactcacagcactctcaataattgttcgaaacaactccttatcacaaatctgtattggaagtttccacatatacaatacatcaatcatctctgaatcataaatgtccctaaacttctccaacggataaacaatacctggcgcaagcgcagcaattgtatcggcatattcctttaactgtttcttcgtataaaccttctgcctgtacagatcgaacataacctttgcatggattccgctcatatccagatacagcaccctcagaagcatttccagtgcatcggatctctttccctgttccagcaaaatggaatataaataatagtacaggtttctggactcttccggttttgagttcttcaactgagtattaaaaatgacccacatcgtggtcagatagtcctgtccgggctttgcatatcgatcatattcctgccaggaaacaccccagttcttattcttgtggatttgtacataggcgtcgtgttcctgaaggaatgcagtcccctcagaggacagcttatatatcgtttccggaacgtgcgctcttaggaagccttcttcagcattttcaagaattcgctcgataagaactgccttctttccggacaccggctgattcagttccctaagcatgtccttgagctccggcagtttaaacaattccagtgcctctcccgattttgcctctataaaatagccctcctcagtcagcttcttatgatatttggcacaatccctgattccacactcgtacagaaaatatgcggcatagttaccgttctcacgtattggctgcggtctggaaaatgcccataggaatacggcttttgcatagtctccctgcagcggcggaatttcaggattgcactgcggcgttgacacggaaacgctgatgttcacctctccgactggtgtgctgaatgatgaagacgattcccgtgccggttctttctcactgacaccagacttcttaaacaactttgaaaatattcccattcttctgtaccccttatctgatctggcttaaaagctcatgcctaaaactgcactatagtaaatgtcaatctgcacccagggacagtatcccttgggctgacaattatgcaaactcaacgatcaaccactacctcatttccgtcaatatcgttaaaacggacctcataagtaccccaatcatatcgaatggcttccgacacggaaatcccttttttctttaaacattctattgttaaattctccctataaaattcaatgagttctttcgctcgctcagaaaaaatattcgtgcagtaatatcctgttatcatctttccaccccgccaaatttgaattcgtaatatattatgattttccagcacttcccacactcatcaccatttttaattacgatttattccattataacagaaatgatataaaaaatgaatcactgtataaattataaaatagtatttcattttgtgctatctaaaaatcttgaaatttgaagacctttacaattacaggctttttctcctgttagaacattcaaaacaacaatgctctttaacgctttggtgcccaaatggtgcccagattttctatagtgatataaaatgatacagacagacataagaaaaaccataactatgcgagggcgaaagtactcgccgctttcggtctgttgttacttagaaagtagaattaaaatcaaaaattcatttatgtgtgatataatgtgtatgttgagaaagtgtgagaatctaaagttgtgtaaaggagaaaaacatggagtttagaaaagtatttgatacaattccagaacagtttgataagtatagacctcgatatagtgaggagttatttgcagatttgatttcctatgcagatatcaaaccaggcaaaaaagtattggaacttggtccagggacaggccaggctacagaaccaattttaaatactggatgcgattatcacgctattgaacttggtgagcatttggctgatatgatgaaaagcaagtacagaaagtgtgcaaactttgatattgttaacgctgactttatcatgcatgattttggaaatcagagatttgatgtgatttattccgcagcaaccatacaatggattccagaggatatagcctttcagaaaacgtttgatttattaaatccgggcggagtacttgcaatgcttttaacaaaagcggattataaaacgccgaatgaagaactttacaataagatacagcaagtttattctgcttattttaagcctgatatagaatataaacatagttcgtttatttattcaaacgctgtaaattatgggtatgtagattttgaaatacgtgaatatcatggtaagcgagaatttacaacagatgaatatgtttccttttgcggaacgcattgcgaccatattgtactttctgaaccatataagagtaatttttataacggtgttagatgtgcagtaaatgaaactggaggaaaggttacattttatgacacgtatgtgatgtacttggcgaaaaagccactttaatgatttttgaagcagaaaaagcttgctgtggaatttttttgcaagagaatggagggaaaggtataaactaccttgccctatcagttttcgtatccgtaaagcatttttacaaggcttattgaacctctaatgcgtaacataatggtataagcaagattgtcctaaattgcctttgtgggtgtgataacgtcgtcctgtgtttataggtattagcttgtttgtggtgctaaaatgatgcccaactttacaaaaccaacttatacgaagatatgggaaaatacacgcagaaacgtgaaaaccattgaaacaatacaacagacacagccttatattaacgagaagtcaaacagatacatcccattccgcccctttgagccatcaaaatccacatggataagcggcattgggaactggaaggtttcacatgaccacaggatcgcagaagcagtacatttataagaataaatatgtactgctatatttctgccctgagatattaaataatactatttattctccccgaagaagaaggaaagagggtaaaacgcctgatcagaaaggagcagcaaatgccatatatcacaatcgaaagcggtgttttatcagatgaacaaaaagaaaatttaatttgtaaccaagatattattgcaataaatcagcatttagcgcaataaataaaaagtctttccaatgttttttgtctttacaaaccacttcttcccggaatcctgtctgccccctggcatttcagcagcccatttattactggttatttttttagttattttttagcataatgacatgccatatttctaaaaataagccggaagcaaaagcgctgccaaaaggcccgccataaacgaaatgacattagctgtcagggcatataccactgccttccctacagaaacatgatacttactaattctatgtatatcgattgtgtatacaaatgcctcaataataaacacgatcccctcaaaaaacacatagcaaagcacaagggccagggcgccctccttatagttcacaacagtgaagagtatatttaaaataatctgtgtaacagcattgacttctgcaataaaaaccagcagcttcctttcacggaattcaaatagcagggcgattcccaattctatggctatggtcaaaaaatccttacaagaagtgcatctgtctcccgcccataatgatactgaggaactgccgtaaaaacgccctgctgatccccatggataacagaggacacatctacagtgtaatagctgtggaaagcatattttttcaggctaattaatttgaatcttatttatcacatttcatttatgccaaaatacttgatccgttcgcttgatatttaatcaacttacatactctttcatcacacataaccactcacttacaatttctgcaattccttctgttgaaggatgaactaaatcctgtgatatatatggtggataattcaataattccaatccatctgtatacaaaaaactctctgacgcatatttttcaacaattttcctatactgatgcgctttctcctgagccacttcattatatccgaaaatactggtcacaaaaatttttcgattatcacctttcattacatccagaaagtctctaactcttgcttcgaaaagttctgtcgtgaattcatcctttatcatattaattcccaattccagtgaagcaaatgtccaatcctttcgtgacatcaggtactcagccattggcctttccagctgagcactgcctgcaacacccttgttaagataatcgcagcccagtctctgtgcaatttgaaacgggtagctatatggcgctgccagcgccaggcttccatgcgttatggaagaaccataggccaggtaagtcttttgtggcatttcagagtccagagggggttcaatatcaccttctattccaacgaagtagcatttgttatagggaagaacaatgcgaatcacctctggtgaaaagggaagattatgtcgtgctgttatttcctttaactgctccatattctctggtctcgtcacggttataggcgtatcttccgtcaagataactcgagaagaattttcccatcccccctgtatagaaccataataaatatatgcaacctgagcttccacacacattgcacttcttaatataatcactgctttttccgaccgcagtttaaaacgtaattccactccggtacaataaaatgcggataattcccttaccccaggatttagcttttctctgacatgttgaggaaatctggacatgcagtaccctttttctgttttaaccatttcctctacgttatgaaaatcaattttctgaaatagcataatcttcccccttatgaacattcgtttccaaccatgccttaacaagcgcaacccaactctgacaggcagaaatattaagatccaatcgtactcctgaagtctctttattagcaagtgccaatccgtgtattccataagggtaaatatgcagttcatgtcttatcccagcttctctcatagccgaagccagcagcatactattttccacaggtaccgtactgtcttcataggtatgccagataaacgcttccggcatgtctttcgttacatgaagctccagagaaacaccctgcatttgcttttcgccaacattttcacccaacagatgtaaaaatgaatccttatgagcaaaattacccgaagtgatgaccgggtagcaaagtatcaatcccctcggctttattacttccgcgttcacccccagagtatcatacacaaaactccgattccagaacacgccaaggctgcacgctaaatgccccgccgccgaaaaaccgcagatataaatctgatttggatcaacattccaatcatcaccctgttttctgataaatgccaccgcctttgcaagttccagaagtgatgtcggaaatcgatttggcgccacactgtaatcgagcagaaagccatgacaacccatagccagaaactgcgtgataatgggctcgctttcccgatcagaacgatttttatatccaccaccaggacatacaatcaccgcaggtcttcttttattttctctcacctctatttgatccaacagatatgatgtaagcacagcgctgccggtcaattgtcctggtacagtgatctccgtttttaaatacctcaaaacttttcctcctttaacagataccaacatcctctttcgttatattcaataccatttcaccagaaatcagcccttccgcatccgcacataccactattctctcagtcgtttttcccagtcgcagaagaacactggctgatccatgatacagatggatacctgtttcatcgtaaggttcatttcccattaaatttccattatcgacagctctgatttttgcatcgccaattattctgaaacgaacaaaagtactttctctaaaacagggatttcctgtacaatccagtgccctcacggttaaaaggacttcctctcctctgcgtaaaacggcctgccgcatattttcaaattccagtttcactgccggtccgggagtaacaagaacatggctgcagaccggttctccactctgatatccaaccacctctatagtgccaggctgatatggtaagaaaccggttattaccttattctgacattcatccggcctttgtataaaataccttttcccatttaagtacagtctgacttcttcacaattacttgctatcatatacggaacaaccattctgttatactgtggaaaacaccagtgttcggcatatggaggcgtatcccaatgctcttttaccatttccccctgcagggagtaatccataacggaaaaatgaaccataggttctttactccaatagctttgataaatatagtaggaaggtttccgcaggccgttcgtccgtatcatcgctccgctccagccttttgatgggtatcccatggattcccctaaatagtcaaatccgctccatatcatactgcctatacaatagtccaattgatccgccgttaagaccggattttcatgattaaaattctgtatctgattcggatggcccataaaatactggtatacctcagttcccagaatcagtttgttcggcatagcatgatgtatcatggaataccactgttcctgataattacaggaaataatatccacaatcgctcctatacggcaaattctttggattctttcttcacagtcctcgatttccgtttcatctgcttcatccacaaatttctgtatatcggctacctttgatacatctatgctgctctcccttttaaagtgaggattcattgcatacgtaacaggtcttgtatcatccatggtcttaacaaaatcgcacagcatctttaaaatgtgaatcatgctgtcctgagcctgattttccacttcattgcctacgccccagatcatgacacttggcctgttcctgtcgcgctgtaccatggcggctacgtcactttcccattctgtttcaaaatatctgccgtatagtccacctgtccatttatcaaaacattcttcgtatacataaaatcccatttcatcgcataaatccataaactctgaagaatgcatatgatgagccgtacggattgaattgcagcccatatcctttaaagcctgcagtctctctctccatatttcttttttaaccgcaattccacagcctcctgcttcctgatgcagacagactcctcttaacttgatgttttttccgttgacaaaaacacctctgtttgggataaactgtatttcacgcaggccaattcgcagttgaatctggtcacattctcttccgtctccgtccattcgtaccagctggagttcatataaatatggctcttctgcggaccataacttaatatcagtgactcgaagacttatttcaccgtctttcaggcttttggattcagctacaatcctgggcgcaatgtctgatttactgcccgcaatccctctctcaagcagtcttgcgctcacccggtccgtcactccagttgtaatggtgagcaaagcatttctgccttccagcgacgtatgtacaaagacatccttttctgataaatgtttgctttccatttctatccatttcactgtcctgtaaattccgcatccgctataccaccggtcaactggttctgccgtattatccactcttacgataatctcattgattccttctgaaacatacgaggtcgcatcaatacgaaatgggctgtaaccatatttatgcctgccggcttcacaaccattaatccagattgtactattctcaaaaacaccgccaaagtcgaggtaatatagatactcctctttcttctgtttaagaaacagttcttttttataccagccaattccccagcgatcatgatatccctgcgcggctccctgtgccatgtctttcttaatcggtgcagtaatcgcccaatcgtgcggcatatccacatcgcaatactcattttctgccggtacatcactttttaacacaaacttccagcctgtcataatctctatttccgttcttggcatctctatatcctccaatgaccattaattttaaatgaatgtgatattcgaaactgtattttgatcaatgaaacagtatggctttgacccgtttttcccgcatacattccgaaacgtaattttgtcacaggcttttaaatgaatctcaccaacctcaacatctattacaacattttccataagaacgttcttaacataattttgtctgtcttcaaaactctgttttagaaaaccttctaattctacaaccttttcactgcccgtaatcgtgcagtttcttatctcgatatcttcaaatactggcaaatcgggagctgcgtctccatccgcgttgtatggaacactatgagccaaaaacttgtcaattctgcagtcctgcatctttatatttctgatatagccgcctcttgccctctgagccttaagttccagaccatatctcgtattttgaatgagacaatcccttaaataaacgccatctacaccacccgattcttcactgccgatcgccataccattccctcccagcatttttaaatcgaagatgcgaatattctccgtcggaatattcactctgttgccatccgggtttttgccggattttatggcgatacaatcatcccctgtgtcgaatttcgtatcaaaaatcatcatattcctggaagaatcggggtcccagccatcgccattatcaatccctcttgattgaattgtaatcccgttcgttgtaacggtatcgcagtagatcatatggattgtccagcacggtggattctctacattgacacctgtaatatggacatttctacactgtataaaactgagtaatcttcctctggcccgcctgcctccaattccatcggaaacgtattcctgatatttttccttatctgcatagatacttttcatggcagttcccagcttcattccgccgccaataatacttcccgtaccacagattcttatattttcacatgtcatcctttttcgattatccgggtctaaatatccagcattaatcaggctccgataacagtacaattcccacccctcgtatcggcttaaaatcagcccatctttatttatcttcccaggatagctgcttctttgctctttagggaaaatgtaattggtcggatcttcgctccccttcagtgttccatcaatctgaagtgtcatatcacttttcaattccaatgcacctgacaaaactaccgcacctttaggaaccagcacaatatctcctgaacagcattgatgaatggctgcctgcaattttgctgtactatttacggttccggttccgtcaacgcaatatggttctttcgtcacatcaatgacagacccagcttgtttcgtttgcacctgcaggggattagacttttctgatctgttctctccctccattaccgcctctaccttgaatatataaggcgtgcatccgctgagtcctcttactgtataatgtgttttatcgggtcttgtacgggcgatcagcctatcatcctgatacacatcatatccctgtacgcgatcgtacacctccggtttctcccaaaccagagtcacactgtcagaagagatggtggccggtgctgccatcaactctcttggtgcatttttcgtattaaacatttatgatctccttattccttccactgttttcaaccctttttcatctctctgtactctccaggagtgacacccgtatattttttaaatactcgggaaaagtaattggaatttgaatatcctgtatgaagcgccacctctgttaccgtccaatctctttccttcaataatttcttcgccttttccatgcgagttccctcaatatatgcagtaagattcattccagtccgctctttaaaaagagtcgataaataactgacattcaagccatatttacgagctaaatctgccacatttaagttatcactataatttttttccacatattcttttatattagcgatcgcatcggttgtcccttgatttttcaccattctaagcaaacgtctgactaaattcttcaagctgtctttcagttcttccacattttcatacgtaaggagataatctctgctcttaaaatcatgaaacagaatattgaaatccatatcatcgcccgcctctctgggaagatggcaaagcataaccagaatttcatcaattccctgttcgatcagagtgattggcatcgtctctataagcagcccgtcaatgctacttataagttcatcctccacacatatgaaatccccttttctgatcagaccatagacctgccccagctcctcatgcatctttctctgtttttcggaagcttcactgctttcccatgaagagcggacaatgatccttttctgaggacagaagagcttccgtttcaaaaagcaaaggctttgtgcaactgttttatgaaactctcctcgttcaaaaacctgggaaactgcggcccacatcggttcctccatggcggataagacagactctgcacagacacgccctggatcctgactctctgccttcatgttaattaaaaacatgtaacagccgcttcttgaacaatcccgcagatcatatgcacagcagtcctggttcttcacggtctgttccttaacaatcatcgatattctcgctgccagatcttcttcctgcatcgtataaaaagctaacgcgaggcagtatgggtactgaagaaccattccctggtctaaatcatccatttttatactgcgcagcatatgattcagtttcttttcgttcattctatgcagcactttattcagcaaagtttcgaattcgtctttatttacaggcttcagtaagtaggcctctattcccaattgaatcgcagtctttgcataagaaaaatcactgtaagcactcataatcacataattgatttctggatacttttttttcgcttctgtgataaatgccagaccatccattttgggcatgcggatatccaccagtacaatctctggattaaaggtatccagaagcttcaatgcctcctcaccattcccagcctcttcaatctctgtgattccatactttttccaatccatccgattacgaatactcttacgtatgaatttttcatcgtcgacaatcatcactttgtacatagtcatcttctccttccagtatccctccgccgcctgttgtctcagtaagcttacgaacgaatggaatctttatggaaatacaggtacctcttgtctctttgctgaaaatttcaatggaatagccatcaccataaaaaagctttgatcttaaatgaacattcaaaataccaagacttttatattgttcaatgaactcaagtggacgctctccagttactttaagccgttcattcaactcctgcagcttttctttttcgattcctgtcccgttgtcataaatcataatcgaaatctgatcctcttctttctttatccgaattcggagcattccgccggtttcagtttcacttagtccatgggatatggcattttccagtaacggctgtaaagtaaatttaaggatttgacaatccatgcattcttcatctacatcgtaatacacctcaaaccggtcctcaaaacgaatcttaataacagtcacatagtttttaatctgttccaattcttttgctatcactgttacattttcaaatcgtgtattataccgcagcatatcgcttaaacacgtgctgacctcgatgacttcattatccagaccttcacttgccaggcccataatggtttccagaatattataaataaaatgagggttgatctgctgctgaagagccttgatttctgcctcttttacaagaagctgctcggattccacccgcttgatcagttcatcgattctcctcatcatcgaattaaattcctgtatcaaaatattgatttcgtcttctgtatccggctgcactctggttgtcaaattcccccttttaacctgctccattccttctgccagacgtttaaaattcacagtaatgatagagaagcatctttttgaaatcaaaaacgtaaagccgacaattaccagcagcataaaaatcaacaccggtataatcctgttctgagcccttaaaatctccgcttttgagctggcaagacaaagatgccatcccgtactctccgaggtcccataagtaataatgtaatctttgtcttcatacgtaccttcccggttattttccaacagttcagctggcaccctcacctccatcttgtcgtaaaagagtacattgccctcgccgtccaaaatcgttgcgccagctatcttactaaaactgtggagaaatcgttccttcagatactccatgtccatatcaatctttaagtatcctactacattagggctataaatgtcctctattttatagacacaggtctgaacggaaccaaaaccttctccgtttttttcttctgccatgagtaccttcttgtttcttgtccatataatttcctgataccagtccttatatcggtagtccggaataggaatcgcctgctcttcctgtatcgaatacatattcgtccaatggccggacttgaaaaagctcatctttaaatcgggattcgaataataatactggctttcaatcccgcgaaggagcgtcaaatctgatgcagtatcctgtttatttctcatcaaacgaatgatatcccgattataaataattgcatcagcaatatgatcaacatcatcaaaatactgctgcatcatagtcaaatttgactccattaaattctgccgcagattttccgcctgtttcatggcattatcccgcataattccatataaaaacatcgctaccaggagattcgatccaatgatgatgagaatcagatattttaaaaatcggtgagtaattgtctgtttttgtttcatattctttcccatcccctgtatcttactttgccttcagctctttcagttccttctcgatattctcaaacgtataatttaactcctgttcagctaacaaatacatggacacttcattacacattgcctcaattccggcattatacagaactcccactgcgttctcggccggcacgctgtccatcaggaaatagtttgcatgctctggaattcgtgtagcggtaagatatctgttctgtactgatggagactgccaggctgaaaccgtactatttcctgccaataaccttccaccttcctcgcccacacagaatttcataaaacggtaggcctcctccggatattttgtcgattctgccatcgtgactactgcggtagtataaacgtccgttttatcatcatcctcccaggcggggagttcggccacatcatattcgaatgacagaccctgttttttcatttcctgattgatcatattcacttcgccgtcttcgccaaaatacattccgagcctgccttccaaaaacaacttgtgatagccgctccattcatcccccgttctggctagatacggaaaggcttctgcgaattcactggtaaattcatggcaccactctgccgattcacgaaaaagttccaaatcctgtggattaaatggattgtaagcccctcttgtccgggctgggagcatccaccaggagctggaactctcaaaccccagagttccgtaaaccttcttattatttgaccagcctgtcagctttctggccttttccttatattcttcccaggtccagccttctgccggatatttcactcccaggctatcgaaaagcgttttattataataaacgcagagttttcccaatcgataaggtatataatagcaggcttccttatcatcaagagcttcataccatggggcataataatttgcctcctcagtacctttataccatgagttaaggtctttcaggatttttttattcttccagatagcggcttccccagcatctggaaaaaagatgcagtctgcttctgcctctttattttttatgcgcatcatctgctgtgtgtactctgaatccggtatcagatgaacttgtatcactgtatcattattcttagcttcatatgccctcactaaaagttccagattttcttcttcgctctgtccggcatatacatttaaaaccgttcggccaaccgggcctgtctctgtagtttcttctttttctgcctgacagccaactaaaaaaaccgttactgcgatggtaatcattagaaacaccagccattttttcatctttctcccccccattttccgtactgttaaagtgttcttctatcaattataatcccatcttaaaaaaacctcaatcagccaatcaacgcaaaccagagctgctgcgtttagcaacagctcctctttcttacccttttaaaccactggtactgattccttctacaatatatttctggaaacagaagaacagcagcactgggggtaccagcgataacagtcccatggcaaacatggctccccagtctgtcatggaggttggatcagagaaaagtcttaatgccacagatacagcatactttttaggtgaagtcagataaataagcggaccaaaaaaatcttcccatttccagtagaactggaagataatggaggttactaaggacggctttatgagcggaagaattacgtttgtatatactttaaatctgcctgctccatccagaaacgccgcttcatctaattcagccggcacagatcgtataaactgcatgtgctggaagatgaagaatgcacttccaaaccaaagcggaagaattaaaggcaaatacgtgttaagccatcccaatttgttaaacatgatatactggggaaccataaccacctgtccaggaagcatcagagaaaccagaatcgtcagaaagcatacattcttgaaaggaaattccagcctggcaaatccataggccacaaatggacatgtgaccacagtacccaacacacttagcagtacgataacaaacgtatttttaaaaaatgtcgagaaggaaataccgccgaatcctttccagccatttatataattctctatcttgaaatcccgcggtatcagattagccgcatccacaaatacctgagagctgtcttttaaagaactggctatcatccatagaattggatagagtgaggtcagggcaaataagatacaaactaaatgaaacaatatatttccgatctgtttttttcttctcatttcttcttccccccactctcatagtaaacccacgcatctgaactccgaaagaccagtatagtaaagaacaaaacaatcacaagaagaatacaggataaagctgctgcatatcccatgttaaagtccttaaatcctttctgatacacgtaaagctgatagaacaaagtccgattcatcggccctccattcgtaacgaccaatccctgtgtaaaggtcataaaaccattaatcatctgcatgaccagattaaaaaagataatcggtgacagcatcggcaaagtaatggatatgaaacactgcatcttgttcgccccatccacggtagccgcttcataataagaagaggaaatatttttaagtcctgccaaaaaaatcagcatcggcgaaccaaactgccagattgccattagaatcagggaaccaagagctgtcttcggatccgccacccaggaaatatcgacattgattccggtaatcatctcaatcagtgcattgaacgcgcctgtcctggaaaacagatttcgccacatgacagcaactgccacacttccgccgataatggaaggaatataaaataaagtcctgtagaccccaattccttttcgtttctgattcaaaagcatggccaccaaaagagctgccagcaacttcagtggtactgataccagaacataagtaaatgtcacctttagagaatcaataaattttttatcttttgtgaaaatctctatgtaattttttatcccaatccattccggcatgctgagcatattatactctgtaaaagaaaagtaaatcaggcagatgaatggaatcagagtcagaactgtaaatccaaacaaccacggagctacatagagatagccctcccagcgctttcttaacattttattattcatagttatctccatttcatacatttgaaagtaaaacgggggctataacacttccgcccccgcatctttattatggactcacctaattttagcagcttctgctattgcgtcataggcctcctctggagttacatctttatacatcattctttcttcatattctctgataagtttctgaatatcagtgctcccttccatagccggtgcatcgttagcagaactataatccacagctttatctataatagccgctacctttttctgattatcatcaaacatgctctccatgctttcacgtacttgatcagaagcaggcataccgcgttctgccttcattatcttattagcttcttcgtcgttaatcagaaagtcaatcagtttagctgccgcctctttgtttttagatttgctggacatacaaatatgtactgatgcaggaaccatggtagccttactgtttactgcccccggaagcagaatcattttaagttctttatcggatgcgtttgcataattcgcatactggtttgccggtataatggtaacagccgcctctcctttcactaaagaactgtcttccggcccattttctgatttcgatacatcatatggaggtatcagtccttcctctgcccaccgtaatttcatgctgtaataatcaacaaacgtatctttggagaatccgattaggctgtctccttccgatgcatagatcctttcgccctgaagccggcaccaatattttaacatgtccccttcttcctgtaagaaatcaccggaagcatattttcctgtcacctctttcagcttgaccaagtcagcctctaacgcctcccaggactcataaccgttttccggaatctctaaaccagctttttcgaatgcagatgtatcgacaatcattcctctcgtggtaacgccaaaaggcaatccatataactgttcgccaaccttaccttcttcaaccagattaccggatatggaagaaatatcgatcaacccattctccacataactattaagcggttctgcaatcccaccgtctaaaaactgctggtaatctccgctgcctatatagccctgatgtacatccgggatattgtcagccgtcgacgccaccgataagttttcccaataggaatcccatggatagaagcttgtctctacctcgatatccggatttttttccataaacaaattcactgcttcgttggttaaatccgctctctcctgtccaccccaccaggcaaaacgaatggttactttcttaccatttccgttctcagaggtttttacttctccagtattcgctgcagctccagtatctgcagttgctcctttatcagaaccgccaccacagccagttaatacccccgcagccattgtcgccgctaaaaaaagtgctgtcattttctttgttttcattttatccttccctctctttcttatttctgcctatatcatacaatgattctgcatcttccaactataaaaattcttggaaactatgtgtactttttttgtatttatcgtaacatggttctacaatgaagctctcaacctccatataagcagttgtctgtttttgtgacaacgcataaagtcccataacaaccccggtaaaacatttccctgcaatttcacaggataagaatctggtagaggcggaacaggccagggtaacctctccctctccaatcgcatagtaaaaatgatactgttctttgtcacattctattctaagtctgatttttccgctttcaatcggtatcaggcatgctgtttgcaaaaaatcttctgcggttttctccaggatcagaaactccccttgattggtctttctttttccaaagcaatagtgaaagcctgattccagatagatcgccagcccagactcatctcccagctcttccgggttaaactgatacacaatctcgatcacacaattaaaatcaggctgtctgaccgcagcaaatgtattgccaatatcggtacaaactgactgcattgaagggattagtcgaagatatccttcgccccgcttaaagagggcttcctttcgttcccgcagaaaaatccattgaggttcccaactacaactattaaaatctgcttcccaacgcgcgagcctcctctgattattccatagaggcccctctttttcaatcgcttccattctgtcaccttttattgtcggccagccatctttccatacaaccggtgtcaaaaatgtttctctccctaagtggctcatcgttcttcttgcaggtcgaatcgccaggtgaaccatccaccagtttccgaaatgatcctggaagagatctccatggccggaacactgtacttctctcgttgtatcatgacggtttgttaaaataggatttccactgtatccttcatactctccccaaagagatctgcttctcgcaatcgtagccatatgattaaagtaagtccccccttccgctgccatcaggtaataccagccatcatgatgataaatatgcggtgcctccaaatagccgccgcctgttccagaccagatggaagtcactggactttttaacattccagtatgtatatcaatttcctccagtgtaatctcttcttttcctggatggatagtctgatttgtacagtaatatgcccttccattctcaaaatacaaggaaggatcaattcctcctaccgatacccacacaggatccgaccattcggaacacggatcggatgtagatacaataaagttaccatattgttctagagttgccgttacatagaaaacacctctgtcatatcggatagtaggggcccagattcccccagaattgcccacatgccttaaattcatttgttccgctctgctgatacagtttccaatttgttcccagtttacaaggtcacggctgtgaaaaattggaattcccggaaaatattcaaatgagctgtgaacaaggtaataatcttcccctaaccggcatatactgggatctggatgaaagccttttattattggattttgaaatttcatatatgctcctcccacgtgaagtatttttattgcgtatcagaaactccgtttatcaagatactactttattttatctaatttaattgtttaaaaatagcaatatttttagatatgacagaaaatattattgggttggcaatattggatttcatccaccttacgccatgtcgtaatctcctgctcccagtaaactcttactttattatatttatacaccgcgtttaagtttttatttttgcatgttataatgtacccagattaaaattgaaacggaaggaaaactctccgaaacaataaatatttgtaacgaaataaacgtgtaatttgcaaagtcaggtcggaccttactttcctattgatttatatcaggctgaaaagggaagtatacaggaactgggcaagtcacaatatcaagaagggaagtgctatcatgccagccgcacaacaacgtttcatcactcttgacgaatacgaagctttaccggaagatacgagagccgaagtcttcgatggtcagatacagtatatagccagtccatcatagatacaccagactattcttttagaactgtcatcatacttaaattcctatgttaaatcaaagaaggggccttgtaaggtatttcccactccatttgatgtaaaactcgatgaccaccctcttttaattgttcaaccagatattatgattgtctgtgatacgtttaagctggatggaaaacgatgtaacggtgcacctgacttcatcattgaaatcgtgtcacccaacaattcatccgatgactatatcaaaaagctttattactataaaaaatatggtgtcagggaatactggattgtagacccaaaccgccggactgtatctgtaagctatttcgagagggatatgattagcataccatatacatttagctctacgatcaaggtaaatatatataatgacctttacgtggatttcaaagaaattgagcaaatgcttacctcgtaattaaaaaaattgcttaaaaaaggcctttttacagcttttccaggttgtaggcatagttcaattgacgtatagcagtgcatttataaaaatgaatatgcactgctatatttctgtcctgagatattgtataataaggtaattctggacttatggaggggaattaaaaatagtagaagttaaagagcgttcgccgaaattgatagtacagtttatagaagtatgggaaaaaaccgcaggcgttgaaggccattacccacctcataattgcagaagatgagaacggtgtgccagtggcttttatgggagtggaactcgaaactcttgaaatgctattcattgcccccgaagtacaaggaaagggggtgggaaaacgcctgatcagactgaacggcctcctcatagaacccggcttccgcgtagtccctggcaagctggagatagttctcctcatagcctctcattcacccttctaagaatgcctgtagctgattacgctcctcttcttctgctccataacagagttccgatagagagacatagtcaaagggatccagcttcagattctctctgatccagtccgctgcttcatccattctttccagttttcttaagataactgccttcaatcctcttgccttcacattatgccagttcttcacaagacctttttccatcagttccagcgcgctgttatactccttcctgatacaggatatcacagccagatagtaaaaactcatctcctgttgttcactggaccacgctgccttatagaacatatcataggcttcgtcgtaccgtttttgataaaacaggctcagtcccagcttataatatgcctcgctgtcatagggattggggttcttccaggtcagacgcttcaccgcccttctgaaataggtctcactctccacaaataagcctcttgtcagcatcagactaccatatgccgtgttaatcctgctatcatctggatctcgttttagcccttccaaatagtaaggatctggtaaataggttgcatgacggtactgctcgatatgaagccctgttaaatacagttcctcattagtcatgatctgctccggttccttcgcagcctccgccggagagggaagctttggaagttcatctgccaaaggtgtgaattctactatggttcttccatcttcatcggacaaccgcacggtgtaatcggtcgtctccccgccttttaagtccacgtaggtatgatagactttctccggactgaccgctgccatctcctcaaacatgcagatacccttatatagtacagacactctcgcgcactcatactctgcagtggtataggctgtaatctccgcctggttatccgtgatttcaaaattaattgccccatcgacggtggcatttttcactgcacccacgcccttataaggcataaagtactgtttaaatactttctcctcaaacggcttcaaccaagtgaaatccggttgattgtcagtgaatacgccagtcatcagctcgatatacggcccgtcctcatccgttaaattccgatcccaagccttgccaaaatcgccacagccccatatccaatgtcattaagctaaggcattagaggcatagcagaaaaaaacacagagtatgagttaaatcgtaccctatgtttttttgtaatattttaaaattcagttgacaaacagtgggaattgtgcggcttgctttcgctaaaaagagcgaaagcaagcccttgtaattaagaaccatatttcgtattacaaggaggcacatcatggcacaatctctaacattttttcaaacaacctttatggacattcttgatgaaatggacgaatgttcttggttattttctaaaaatccactgagcgatttttcaagaaaatcgaaactgggatttaagaaaacactttctattattctttctcttggtagtaaaagcatccccaatgaattattagactattttcaatgtgcacaagatattccttcagcttctgcatttgttcagtctagaaataaattacttccagaaactttggaatttttatttcatgaattcaattctcgttgtaatccttgcttaagctataaaggatttcgacttttggctatagatggatcggaacttcaaacgccaactaatccagaagataaggattcttattttcctaatgtagagagtaaaaaatcctataatctgcttcatttaaatgctatgtatgatttgctttctcatacatatgtagatgcttttgtggaaggtcaacaagtgtccaataaacaaagagcactaaaccgaatgattgatcggactaacatcttatccgctattgtacttgctgatcggggatatgaatcttataattgtttcgctcatatccaagaaaaaggatggaaatttctatttagagtaaaggatggaaccggaggcataacaagtggattagatttaccgattacagaggaattcgatttgtgctttaatatgtatcttaccagaaaacaaaccaatgaaataaaagaattattaaaagataagaactgttacaaaagacttaccaaagattttgattatttaccagttaaaaacaaaaaatccattcctgttaagccatattttttaccttttagaattgtcagattcaaactaactgataacaccgtagaaacagtccttacgaatttagacatggaagacttccgcctgcagaattaaaaaactatattcaaagcgctggggaatagagacttctttccgaaaactcaaatacacgatcgggctattacattttcatgcaaaaaaggtggagtacatttgtcaggaaatttttgctcgaatgattatgtacaactttacagaaatgattatctcacacgtgattatagaaaataaaagcagaaaacatgcttaccaggccaatttctctactgcagctcatatctgtcggcaatatttccgcggaaatgtgcctccacctactgttgaaactttgattgcgaggttaattctgcccatccgacctggtagaagtgtaccacgcaatctatcgccaaaaaaagcaaaccagtttctattatagagtagcataaaatgcaataattgaatatgattttttgacaggcaaagagtctgtctttttgccgtgtcaaaatataaaaagagaccacatcttttttctggaaatgatctcttttttattcgttctctctttgcaatgccttagcttaatgacattggtctcacggcctcagcgatttttttatttggggagttttttacagctccaatcttcgagtatataaaaaaaactaaaaagtggcatgacctttcgacttttttgtccaaagtattgacctcaataatcatgatattaccgttatttaatccgcacctatcactgcagaattgtttttaacagagactgggaactttctcaaaaccaaaatccaggtcagcacgcctaagatcatcatccctatccctcccagcaggaactggcccgccgacgtatttccgccaaaggcttttccggccacgctccctaaaagcacgggagaaaccaggccgccaatcccgcctattacggaaaaaatcccactggcctttgccactgcctccggttccgtagagactgaaatcaggtaggagcactgtgccataaaacagcttagagaggctccgcagcaggcactcccgatgtagactcccgccattcccggaataaacaggatcgcagcatatccagcggcagcggccaatatggatacaggcagcgtatgttttccgaagcgcttcgagataaacgggaacagcatcccaactatcagggcaaaggccgcgttcactgccgtcaccacccctgttacagccgtattatccgcaatctgttccagcacatagattccgacatttgtactgtataccgtaatcagcagcgtatggacaaatgaagccgctgataccagccatacgccgctgtttaattttctgtgcccaccgctctcccgctcagacgccggcgactccggcagcagcagagcgactccggccatcgccaggaatgccgcaagataggcaagatagaaccaacggaagcccagcccagccagcgccccacccagaagattgcccgtcatggaacccaggcccataccgaccacgtgaagccccagatatttcgccctttccgccggttcgaaaaattcagccacaattgccgtattgatcggcgatatgattccgaatccaaaaccaatcaatattctcgatgccagcagaaccatatagctgtccgtaaaaaacggcgcagtcccgcagattcccacaattgccagtcccgccagggccagcttctttttgctgaaatgaagggttagccagccgatcatgagggatcctaccataagaagtgcatagggaatggtctggagaagctggaccccgctggttccatgagcggcgtatcggatatttaaaactcccagtatgggggcaatgcctgtgatattgaacccgaatgtaaatgcaatgagtagaattgcccccgctattttcctgttcttcatctctcatgctccagacggaccgcctcgccggtgtcggcagattcccggaccgcctccatgacacgcaggacccttctgacctgttccggcttcacaatgatctcttcctccccgtgaaatgctttcaggaagtgcacaaaataatctctctgctctgcaacggtttccggcagcggttcttcgagtagaaggcccggagccgccggcccgaagctgcgggtagggcctgccgcagtcatcgtgattttgcccggcacattctccagcagatgagcggtcctcacgatctttccctcgcccgcgaatccgtcgatcaaggcgctgcccttgtctcctccaataaaccacgcgcgttttggtgtcagataatacgttcccagctcaatttccgccatgatcccattctggaacttcatgataatcttgaagtagtcatccaccttctcattaattacgttccgcaaatcggcgtacagggattcaatgggggaatccaccatatctaaaatctggtcgatcaaatgcaccccccagtcatagagcattccgccgcccatctccggaaatctgtgccagtcgtgcatatttccattaaaaccatagagctgggacttgatcacatagacattgcccagaagtccctggtcatacacggacttcatgatccggtaatccttatcccaccggcgctgctgatgcacggtgaagataacccctgcccttttcacagcctctgccatccggtcgaactgggccaccgtcatggcagccggtttctcacagataatgtgtttcttcgctgccgcgcatttctccaccatttccaaatggctgggattgggggtggagatcatcaccacatcaatatccgccttatcaagcaactcgtcgatggaggagtaagtctccaccccctccggcgcgtcctccatctgcaccgggttaatatccgccacagcggttaattcaatatcctcaaatgtttttaacatatcggcgtcgcagtgacccataaatccatatccaacgatgccaagcttcattttcttcatccctttgcccctcctaaatgacaaactgttccatgtaacgcttactcagttccaggcttcttctcaccttctctgcagttccttcaaacgccttatcttctacctcaatgcacgtatatcctttatacccgatatccgttaaggcgctgacatactttccccagtccacatctcctaaccccggcagcttgggggacatgaaatccaatggataagccatgatcccaaccctgcagagcttctccggatacaccttgatgtccttataatgaacatggaaaatcttatccctgaattcataaatcggctttatataatctatcatctgccatacaaaatgcgagggatcatagttgattccaagattcttgctgggaaggatctcaaaaacctgtttccagacagccggagtcgtcatcaggttctgtcctcccggccactggtcccgtccgaaaagcatggggcagttctcgattgcaatttttacacgctcctcctccgccacctgaatgatggacggccacacttcctttaccagctctaaattttcctccacggtcgcagactggtcccgcccgatgaatgtcgtcaccaacccgatccccagtctcccgctggcccggatcacattctttaaatgctcaatcacagtttcccgcttctgtaaatccggatccatggtattggggtaataagccagcgcggatatctccacattctttgctgatgcgtattcggtaatgtatttcgcatacgcctcgtcctccaggacccgttctgcgtctatatgggaaactcccgcatagcgcctttccgccttgccctggggccagcacgctgcttccacgcactggaatcccagttcactggccgtatctatcatttcctcaaaactgctctgatctaaaatcgcactgacaaatcccagcttcatctgttccttcctcctgttcttctttgcacggctgcaggacatcccaatgttcggccaccatatgattctggatccggtaaatatccaccacccggcactttgtctgtccgcggccatccacattttttaagtacaccgcggcaaaatcgtcctccgcgataatccgtacaatctctaaatgaaattccggttcctcccggaatttccgggcaaaggcttccatgaaagccgctctcccctgccccactcccgggttgtgctgccggtagtcctcccgcacatatttgagggccgcggtttcatcgtgaccattaaaaaattcctcatagaaattccggagcatttctttgacaccggtatccgacatcgttcctattcctccatagcggcaattgtttcatcaaaattcttatactttttcagctgttcctccagccactcctgattctccatgatcttgggaatgcagacctccttcatcccctcaatctcccagtagtgatcgtacaatccttccattctcaccctggacacctttaagtcctcatcctgatagcagatcttcatcctgccgtcttccagagtcatggttccctttaccccgcaggtagcacagtatacctcgggtgcctgatccatcatcatcaccttgccgtgacagacagggcagacgccctcctcgccataccactccacttcttcatagggctttccgactgcctctgccacccgtttcccaagctcgctgcattttcccataagctcttcatcaaataccggattggcgcggcgtccctgtccataggcgtcaatctggcctaccaccttcatataaatggaagtgccgaacatggtcatcgtcggaagccccagcgccacccaatgaggcgtatccgccccgccgatggacatgtaggcgacatagcgcttcttgaaataccgggggtctaagagctcatcgccagtctttccctccgcgatcctctttttctggatttcatcgagagccgcccggtcatgggctgctccgaaacggtcaataaaatttttcatctgcccggtggttcctacggagaagacgggcgctgccacgataataccgtccgcgtccaggatcttctcctccagcctggcgtaatcgtccttcttgatacagtggacattcccaccctcatccctcttcatactgcacacgccgcagccagagcagtggtcgatcctcatattcacggtgcgtacaaattctacgtccgcccccgccttcattgcggcaaacagcgcttcctttaccataatctcgccgcatttcatgttccgtccgccaaaattaattcctaaaaccttcatagcattctcctcgttctttttttaatattgtttaaacctgccgactctcgtcaaacggtccggcagccgcggcacccggcccagggtacggaccacggcccgttccccgcatgcctccatacagacggtgcatttcacgcagtccagctcctccgtcatgtggatatatccgggaaggccctcgatgcagtccttcgggcatgccgggatacaacggccgcagccggtacagcggtccggatcaatatagacgcgaatgaaagcagggcaggaacccgccgtacactttttccttctgatgtgatcctcatattcagcgccaaagattttcatggaatccagggtgaactgcgctccggtctgtcccacggaacagaggcagctaaactccatggcctccccgatctccctcatgatttccaagctgcccgcctcccctttgccggaggtaatctcatggatcctggtataaagctggcctaagccctcccggcaaaaagtacattttccgcagcataccctgcgcgccgcctccagacgttcctccgccatagcgatcatgcagcagctctcatcaaacaccgtgatgaccccatttcccagtatggtatctgccgtaaccggttcctccaaagctgaaggtccacagaggcggcttcctaactggactgccttaatctgacccgcgtaaggctgcggcagcagagaagtgagcttcgtaccgtaaggggcaaaaatgggttcccccatactgacgtctccggaagtacaggtttttaccgccaccacggctcccggacaatacgtgtcctccatcacatcacataaagcagccagagtctccagatggcagagacagccccctttcatgcggcgcgtgtccgcaatcccttccagaagctcgacgttgacgccaaggaccgacgcctgatcctccagttcatggatcagcgccgtctccccttccggaagatagaggcgcagcttagaagcgctgaggagccgtcccagaatcgcaagccccagcaacaccttttccggctctcttttcgcaaaccacagcagcatccggtccgtatcctgattgtttaaggcccctgcggcaatcatcgggccgtcagaaggaaggcgctcttctaaaatacgccgaagcttcttttccaggttttcgggacagattccgtactccttcaaaccggactgtccaattttttcaagcaattcttcctggctcattccgcctgttttctcaagtccgttcattcccgacctccttcgctttcatagtctccccagagtctgggctgggtgatattcagccttaaatcgcattgcaggcaccgtccggcctccccgcagacgccgtctccacatattccatgatccaccagagtaaagctgtcctttcgctcctctaagggtgtgatggtattttctgcgcgtttcctgcaggcaaagccctcttctttccctatgtatgcctccggctcctccacaggcgcgagaatctcgctgatgtccccatcgccgcctaagtaccggtcaatggactgcgccgcccttcttccggactcaatggccgcaattacggacttcgttccatataccgcgtctccggctgcgaacacgccctctgtccctgtctcgcacgtcttctcgtctgccgcgatggtgttgccccgtcccagaggaagtcccgcttcctccgtgattttcggccgctgtcccgtagcaaatatcacagtgtcagcctcgatacagtgttccgatcccggttccttctcaatcacggcccggcggttttcatcaaacgtaaacgacttcaccttcatgaaatccactccagccacacacccgtctccgataatccgctcaaaggtctgtcccggatggatgaggatcccttcctcttttgcctgggtaatctcctcctcatctgccgtcatctgtccggcagcctctaagcaggctaagtgaacggttttcgctcccagacgcttcgcggttctggcgcagtcgaaggccacgttgccgccgcccagaacgatcactgtgtcaccgataccggttttctcgtgcagactggcgtttcgcaggaaatccgtgttcagcagcacgccgggaagacggtttccttccatgggaagacggacgccctgatgggttccgattgccaggagaaccgcatcatattcgtttctcagctccagaggcttctccacccacgtatttagctgggtatgtatccccgtttcctcgataatcccatactcttcctcgatgatattccgcggaagacggtattccggaattccaaactgaagcattccccctattttcggcagcgcttccttaattgtcacatcatgtccctgcttccgcagataatatgccgctgtcattccggcagggccgccgcctatcacgcagactctctttccggtgtccggaagctgttttccacggcccttccagcaggctctgctgtccgcctccgccgcataccgtttgatttcccgtatggacatggcctcgttgatctccttccgcttgcactccagttcacattcgtggctgcacacatatccaagcgtctttggaaacggtaccttttcccggatcacagcggcggcctcatcgaaccggccttctttcacataacggatatagcgggggacatcagtatgggccggacatgcggcccggcagggcaccaccacatcctccttaggttttccaggatttgccatcatgagcttatcccggatggtacccgtggggcagacctcggcgcaggcctggcagaaacggcagtccgtgtccatcagcagcttatgatgaagggtccccacatacgtttccagcccttccttctgaaactttaaaacccctacgcctctcaagtcctcacagaccctgatgcagcggccgcagagaacacagcggttcatgtcatgggtcagcaggggatttgattcctcctgcttaaagccctttgtccggtgtctcatccgggaagtagcccctcccatatactggatcagggtctgcaattcacagttcccgtattttggacaggtggaacagtcctccggatgaccggccagaagcagatccagggccatagagcgcagacggccaagcgtctcacccttcgtccgaacggccatcccgtctctggccttcaccgtgcaggacggaagcggcgtctcctccccatcaatctctacgacgcacatccggcaggaaccgtgttccggcagatctggatggtggcaaagatgagggatatagattcccgcgtccaaagcacattccaaaagagttttgttgtcaggcacctcaagccggatgccgtctatggtgattacagccatcataattcctccgttttctcttgtctgcttatccggtcggatatccggccggactgcacatatcctacggcgctcatgcctgcgatccttcccgtgtttaccgcgtaacccatggagttgcctggcagcaggaacatgtagctgtcgtcatagatattacaggagtcggctcccgcgcagtacagccccggtacgggctggaaaaactggtcgcaggcctcgcagttctcgttgattctgacgcctccgacagtcccgtagcctcccggatggacggcagccgcatagtagggtgccttaaacaaggggcgtaagtacttgggatccttgaaaaactcataatccctgctgtcgcagaagtaattataatcgtcaatggtctgttttaggttctcaccgtcgattcccgccttttccgccagttcctctatggtgtccgccacaaagtaattgctggagccattcttctccaacatcccgattccttcataaaaatccgagacatccggatcgggcgtaactaaactggtcacatccacaccgtttttgatgtagtattttacgatagagctgtccacaatggagaagcaggtcttatccttctgatggttggcaacattgcttaaataggtggcgttctgcatgaaatcttcattcatgactcttttaccgtcccggttcaccaaaaggttcggctgcttcataatattggtgacgccagaggtagtcgcttccccaccgcctaaatcgcaggccatctcaatcctcacaggcatccggtccgctcctgctccccacgccatggtaaggccgtctccggtcaggccgggaattgtgaaattgtacacctctttgccatgctctagcccggtcagttccttaatcatcttcttattggccccggcgccaccggtacagacaatcactgccgggcagctcacccgcacctctttcccgtcaggtccaaccgccagaatcccggtaatcttcccgtcttcctttaagattttcctggccggatgctccagaaggaccgtcacgcccagttcgagggccttctgatacagcgcccggttcataaaggaagcggctctggggccgatgccagtatccgtcttcacgatatgccaggttgcctcggacttgggaaaataccggaatgcgccctcgaactccacccccatgtcctccagccacagaatagtttccgccgactgggaaaaataccgtttgattaagcgggcgtctacattgtaatgagtgtaatccatgaacatgttaaatgccttctctatactaatatcaatcatctgcgccttctgataatggcttccgactgcaaggatccccattcccatattcgcggctccgcctactgccgccgccttctccaccacgaccaccttcgcgcccagctgggctgcctgcacagccgcagataaaccggaagggcctgctgcgatgacacctatttctgctttatactccttcatagctgcctgtttcctttctgattccgattctgtttaagtccctgaccaggtaaacggccggtaagccagcctggaatccagtcattccagaccagggctttcccgtaaccgttattctattcttcgatcgctctgcgaagcgcctcctgatggcgtctcacctgctcgatactgtccacctcaagggcgtcgtttaacattcggtttccctcgtactcggaggacaaatatccgtgatatcccgctttcttataagcctccaccacctgtcgtatggggattgatgtttcctcataattctcattgacgttgtagaacttggcgtgggtatggtaaatatacgggatattgtcgacaatatcctcaggatcgcaccacgtatagtcaaaggttgaacccgcgtaggccatctccgccggagtcgcgtggatcttctccagggcatccataagctgcggcataccgtttgctttcatataatctccatgggcctttcctaagtccagatcatacttgatcttcgtaaagcctttcgtcacccggttttcaaacgcatcctccacgatcttgatggcttcttcccggcagccgtttctgcgcgcctgctccgttaagatgtccgggatatggcggcaaaagattccaaaatccggcatgaacccgaagtactttgtccctgtcctgaggatcatctccatatatccatccgcccagccggagtttaacgagaacggggagtgaacctcgatacagattttcacgtcctgttcttcggcgaaggggatacttccttcaatgacctccatgggcgtggaaaccagggtccgcagtgtcttaaatcccagctcgcccgcaatgcgtaaatcccgcttcatcatgtcaatctgttcccgcagcgtgcaggtccggttatcgtaaatatgattttccagaaatgcgtcgtagcaggtcggttctgtgtgatacttttccatccagccgaaccatttctccttaaattccggcgttatcaccgggaagctgtcgatcatctgctcggccagaagctcgatgccagtcgctcctgtctttgccgtctccctgatgcagccctctaaatccagctttccctcataatattcctgctggtagctgtataaggacacgcttcttccaattttgtaatccatcttctctcctcctgacatcaaatttcaaaatcgtactcgcccgcattgaccagaatacatggcatgtaggacggtgcaatggtctgtgtgcactttatatgatgctttccctttttcagaccgccttccgtcagcacggtgacagtggcatactgtccaaacagccagcggtttgtgatcacggtccgtatttcctccagcgaaaacgtctcgccgtttaccgtaaagcggaccgcttcccgtggatactcaacgccatctacagttacctcgatattccggataatggaaagagtgatcccacggtaatactgaatcttcatatcgaactgaaaaccgattacctttccctctttctccgtattcttaaatccgtctggattgtacatttgtcttggaaacattttatcagtcctttctctctgttttagaaaaatacttcttttccggtttcggcagactgatagattccctctaaaatctgagtcaccacaaatgcctgttccggttttacaagcggttccttatcatagaggatcgcttccatccactgcttctgttcccgtacgccctccgcggatgcgccgccttcaaagaaatccaccactcctgccggggaaatggttttctccatcagttgattgtgctccacggtattatagatcagttcatccttgggatagcttcctccgtggtggatctccgctcctgccttcgttccgcagagtgtggtggatgcctccattgattttaatacgttaagcgcccaggaggactccaggtaaatagccgccccgttcttcattttcaccataccgaaggcggaatcctccacctcgaaggtctccggatcccaggggccgaatacgtttccgtccgggccgtccgcctggcgtcccagcttatagaacacctggcctgacaccgacaccggctcgtaattatccatcatccataaggtgatatccagcgcatgggttccgatatcgattaagggaccgcctccctgcagcgccttatttgggaatactccccatgtgggaaccgcacgccgtcttaacgcatgggcctttgcaaagtaaacctctcccaattccccggcagcgcaggaagcgtggagggtctgggtatcatcgcggaaacggttctgatagcccacggtaaatttcttttcggatttcttccaggcctcgatcatgattctcgcatcctctgaacagtgggccatgggtttctcgcacatcacatgctttcccgcctcaaaggccgctacggtgatgggacagtgggccacgttaggcgtacagacgtgaaccacgtctacgtccggatcgttcaccaactcgtgataatccgtataaactctggcatcatgtgtaccgtactgagccgcggccttcacggcccgctcctcaatgatatcgcagaatgccactacctcgttcaaatcttcatttgctttcaaggaaggaagatgcttctgattcgcaattcctccacagccaacgattcctactcttacttttttcattcctgattccttctttcctgataatttctttcgcgttcttcattgcggattctgagtttctcacggatcccaggcatatcgctttcttttagattgaacagcgctaccgggatgattccgaccaggaatataactgccggaattacattagcggctatcgtgattcccagctgcgtatgagcggacacatcctgtccggcctgatagccgaaccagccgattacggcgactcctaaagctgaccctactgcggttccaatcttggagccgaggccatttaaggaaaaagccgttccatctgtgcggacacctgtcttcaaatccatatcgtccagcgcgtcgatgagcataatcgcgccgcaggggcctgcgatatagccgagtccgtatacaatatggcagacaaacagatacgggatattctgataagggccgaataccatcatcaggagtcctgccgcctgcaccagcatggcaaagtagaccgtcttctttttcccaaatttttcaatcaccctgggggccagcggcatgacaaccgctcctacaatcatctgcatcatcataaataaggtgataaaggtaaaattcttaaccacatacatgtaatagtagacagctaccccgattcttcccatcatggccgacatgttgcagacagtgtataagactaccatcatcatgttcctgttcttaaagatcagcttcatggattctttcaccggaacctggttttctttacgtacaatgactgtctccttacacatctttgcgcagaaccagaacatcggaagggcggctatggcgaatacggaggctgtgatctggtatcctgccttctggtttccctgtccgaagaaattcaccatgggcagcgtccccaagtttaagataatcatgcccagcaccattcccatgagctgaacggtcatcaggcggttgactttcttcgagtcatccgtcatgaccgcaggaaggccctggtaaggcacattggtcatggtgtataccataccgagtccgatataggtgacgtacgcatagatcaaatttcccgtcgttccgaaattcgggaccgtaaaggtcaggatagtgaagatcaccaaaagcggcgcgcccagcgcgatatacggccggaaccttccgtagcgggtgtgggtgtgttccatgatttcccccatcatcgggtcgttgactccatcccatatctttgccaccaggaacaggactgccaccgcgccagccgaaaggccgaatacgtcggtataaaatactgcaagatatgtactgaccatggtccaggaaagctgtgacgcgaagttgccggtaccataggcaaagtattgcagcgggccaattttattatcttttttccccattgtattactcctttttccttttacttgtctttcgctagcgctgtgaaatccaccggtgtttcttttgatttctgtactaatcttaccagatgggattattttcttcttcccatatttaatctttttgtctcttttttttcggtaatttttattgttttatatattttaatgttttgtataaaacgcaatattaatttttcttttatttttttaatatttatggtacagtaagatcagaattatgaccaggaggtatttcaatgcagataattgacaagctgtccaacatggtttctgtctgcgatgtggtccagctttctgaaaaaacggttcttcactcctccttcctggagcttttgggggttctggaaggaacacttatcatcgccggttccggtacctccgttcctgccgcagaggaggtgctggctgaaaaagaagtcttacttcttccgccggatacagaagtctccctttccgccccgcataccgcggttttgttaaggctttcattcctgcctgcgccgctattagacatctgtgatgacggagccctgttctcctgcccacggtttatccggaaagaggccgtagccattctcttactgatggccgcatacgcccggctccgtctgctggaagacccggagaatcccttccggcacgcctgcctgctcctggatctgcttcgccggctggatggcctggccttccgcccgctggatggtctggccttccgcccgcttctttccccttctcatgatgacggcatgaccgcctatcagaaggattttctggttcggctcacagttgatacacgcggccgtttgcgggaggatctatccttatcggaaacggcctcccgctataagatcaccccgcagtatctggcggccttttttaagaaatacacaagcatgacgtttcatcagtatatccagcagcttcggtgtgaaaagggcgccgcctatctgcggtatacgcctctctccccggaggaaatcagtccgcgcgtcggtttaaagcaggccggcgtcttaaaggcttacgtttcaaaggcccgcctcccgctctatgaggaaaagccgcgccttccctttactgcgccgcttcctgtagatggggccatgcgcgctctctccctctaccgcacgccagtcgcccccgccgcagagccttccagacagccagacggcttagcgccggtcacagccgacgccaacaggacgaaggctttcccgttttgctttaaaaggctgatcaatttggggtatgtgtccgatttcacgaatgtcaggatctttgaccagctaatccgcatacaaaaggaaatcgggtttgaatacggacgaatctgccggatactggattttgtggccgaataccgggcaggcggaacaatcatctatgatttcagccgtattttccatattatagacattatgattgatcaccggatgcttccgtttctggagatcagcaacaagctgttccgcattcagttgaatttaagcgaggtggttcccgttaatctggtaaaggactcttccgcctattatgaccggaccctcagactccttcctgattttatacgggcctgcatcaaccgctacggccaggaatccttcgaccggtggcgcttcgaagtaagctatacttattatgactttcaggatactgccgaagatttccccatgacccggtatgtccgctattttgaaaaaatccggagcattatccgcggctattcagcagtatgtcagatcggaggccccggctttacctattggaaggatgcagaaaagctgctggatttattccgtctgttccaggccggacgaaccatgccggatttcctgaccgcttacctctatcctctgaccagcgacggagaggacgcggccctatcccctgaccctgatctgatcttaaaacgaatggcctatctccttgacctggccaggaaacaatttccgggtatggaactgtggattacggaatttaactcgaatctctcttcccgcaatctgctgaatgactccgcctatcaggccgccttcctggcaaagacgctgaccgcggcggcagataggaacgttcaggccatgggctattacctgctctccgatatccccctccgctacgcggattctctggggatgctgttcggaggctggggactgttttccgacttaaatctccccaagccttcctatcacgcctatcggatgttcgcgcagctgggaggttccctgttaaaatataacaggcattacctgatcaccgcccggtctgcaggaagctatcaatgcctgttctatcattatgaacatatatcgccgggattctgccaacgcaatgtggcggttcaggatttagaagccggggaagaggtattcataaaaactcccggctgccattgggaagtttctatccttcacgcgcagccgggcatctatttgatacgaaaatatacagtctccgaatctaaggccaatcttctgtctcattggaaggcgctcggttacttaaacttatcgagagactccgatatccaggcgctgcaggagctatcttccctgactccccagctttccaccgccgaggtgcttgcggatcagctgctgcgtttccggatctctgtggaaagccaggaagtagttcttcttctgctggacttaaatactaataccagggaggtaatgtaatatggattcccttcaaagcttacccatcacatttttggaacagaccgtcctctacgaagcggtttccttcacccacgattcctacgatatcatctatctgctatccggcagactgaccatcgcccgggaggacgtctccgcgctctatacgtccagtgatctctgcatgaccggcaggttaatcccctataccctttctccggaaggggcagccacgtttctccacatcggtatccgcccgcagttcgtggaacagaacctgggagcctttggaacgattatctgtgattctgttcttgagcctaataataactacctttccttaaaacagcttgtaaccggcatcgccgccaggtatttggagaatccggcctatcatgcccttgccatccatggacttttatttcaattgctggatcagttgaaaaaggataactatttttccctcgctgtcgatcccagcattcccgaaaaatacagtgagcgcatccggaccattacctcttatcttgaccagcattatcaggaagccataaccctaacttccctggcggacgccctgtttctcacaccgcagtatctgtcgaaattctttaagaaatatctccataagaattttaaggactatcttctggaaaagaggctgttccatgcctgccgggatgtcagctatacagacaactccatcacggagatcgccgtccgtcatggattttccgatatgaatgcgttcaacagggcttttcgcagtctttatgaaatgactcccagtaaataccgcgatcaaaaacatgcctcacttttactggaagaatacgatacgattcagaaaaacgaggctccgggcgaaattgccacagaacaggccgccctgtacagccagacgaataccatagacgtatccggtggagaggcttttcccaggcatttctccaccctgatgaatgtcggttccgttaagaatctgctcctggacgatttctgcggtctgctcacagatgcaaaaagacgcctggattttaaatatctccgcttccagggaatgttgagcagctcctttatcccaagggtgctccccgattatgaatactattttctggatgtggaccgcgtcctggattttctgtatcagcaggatttgatcccgtttctggagctgacgcgcctgccctgccacgacgacggcttcaccagctccaccattcaggttgcctctattccgaaaagcagccggtactttgaattactggaagcattcctctcgcactgccgctatgcctatccggacgcctggacaggcgaatggatcttcgaagtgtggaaagcccccagggagtctatggcctcctatctggaggattttaagaggatcaaggccctggtcaaaaagtatctgccggacgcttctcttggcggacccggttttgacgcctgttccccggaaagcgatttagatggcgccgccgcttcttttaaggaagcgggaatccagccggatttcttttctgtgtctttaagcctgatgataaaggcgggggccgctgaccagatcagcacagaccgcgacataataaaaaagaaggccagggccgcccgcgcttccatacgaaggcattttcctggcgcttccttctacatcacggaatggaactctgttttcgttccggataccccaatccaatattcctgttttcaagccgcctttatctgcaaaaccgtgctggaattatcgccgctctgcgacatgatgggctactggcttttttgcgatactaatgcctggaatgatcctgccaaagcggaggctttgtacttttggggatgcggtttatttaataaagacctcactgccatgccttctttctatgcgtttgagctgttacgctttctcggggaccgcctcatcgccatgggccccaactactgtgtggccggaagcgccggaggccattaccagattctggcctatcactatgcgcacgtctcctcctttgaaggattgtccactgggacacaactgcctttctatgacacctataaattattcgaacacgttccgtccgttctgcagcacttcgtcttaaacaacctggaaccgggaaaatatcggatcacgcgccatctcttagaccgcgcccacggcagtattcttgatctgtggatcggtggctatgcaaacagtaatattgatgaatttgaatatatgatggatattaaactgcccccggtatcccagcttaattatcttcagaaggcctgccttccggaagtgaggaccatctaccagaacaccgacggatccctttttctggactcctccctacttgcccataatgtctgcctgtgggatattgtccggcaagtataaatctgtatcctacaacactatttttctaaaagccggctctatgaaatctccaaagaaagttatggtattggtatagcatagttaatacgaaatcagcgcatagagaaagccaaatcactgctgctgaattctccagaattaagcagcaatgaagtggcttatttatgtggtttccacgattataattatttataacattatttaaacgggtaactggtatgtccccatagtcaaatgaccattgctccccggttgcgttttgtatcagaccttcacaattatatagttcttcttataaactctccttccttcataatcacactcatggtatcaacagtcagttcacgtatatttttcagtggatttccatcaataaccagcagatctgcgctctttcctgattcaagagatcctgtgatttcgtctacgcgcaataccttcgcaccatttaaagtagcggctacaattgtatccatctcgctgattcccgcacactctacaaatgcatgaagttctcccaccagggtctcaccatagggtgtcatctgagaattgaatgaatctgaaccggtcgtcagcagaatccctctgtccctcgcctttttcagattcgcatagatgcgattcaaatctttttccgcaaccgtttcacccggatactgatcgtgcagagccggatcatactttggtggaaatgttgttaaccatgcgggcataaaattaattgtagggcaaagcgcaatccccttttctgccatcaggtccagagtctcatcatctaaggactgtccgtgaatgatcaaatccacgccagcttttacggagttggcagcgctgccgaaacaatgagaccagaccggaacatgtctcattttacactcatccaccacggcctggacctcttccatcgtgtagtgctgatccattgcggtctcccatctccagataccgcctcctgtagcccagatcttaatggcatccggattctcccgaagcctgcggcggactgcttttcttaaatcccacggactgtccacgcactccccccagggatgtccctctaagtttcgttcaatcgataccttatgagaatcaccatgagaacaagtagcgcaaaatccacggcctgatgcaactacacgcggccccttcattactttctgctcaatcatattacggatatgaataccgaacaaagatacctctccaaccgttgtaagacctgcttccagacattcatgggcctgctgtacagctactactgctttctgaagattatcttctgtaggccagtccgtatcattatccgttaaatttccggagaaatgcagatgtgcatctatcagtccaggcataatcgtctttccgctgatattataaatttcatacccctccggaactgtcctggcttcacctgcataagtaattttatcttcatctacaaggacaaggctgttcccaatggccgccgccccagtcccatcaatcagcagtccgccctgaaatgcatgtttcttcatgtttttcctcctgcacatttcctatgcccaaatgtctccaattgtaaaaccttccgtaaatggatccgttgaatccaataccagattaccgtatccataaatccaggactggccggcaatcgtcggaattaccgccttatggccgccgatttcagtttcttctatcaattctcccttataaaccacgccaagcagtccctgatgacggaacgtctcatttaattttaattctcctttggcatacaaagccgccattctggcacacgttccggttccacatgggcaccggtccaaagcgccgatccatgtagatggattgtcaaaatctaccgctccgctggcaactgtaacggcatttcttatgtccgcattaggatcgtctgtaggtccaaacagctgagaaattgtaatccccactccaggatagttcgggtgctccaccggaagctggtcttgagcagcttttaggattaaagaggatacgcgggtgatttctcttcccatatccggtgtcagttggatccatgggaactgacgaacatcagccatggcataaaacatacctccccatgcaacatctactttaaccttttccaccccgtgaccaatgtgcggcacggtaatctccgtatccgtatagactgcgaaggctggaacgtttttaaatgtaacctctgttactttgccattctcgcatttcgccttaatgccgatcagtccggcgggagcctccagctgaaattccgtatatggttctttcatttcgatcattccagtctcaagaagaacggtagctacggaaatgacatttccgccggacatcatcggatattccgtctgttccataataataaaacctgcagccgcctccggattctttggtggaactattatattacagcacatcggcggatacccccgcggctcacgaagcaggaacttgcgcagtccatcattataaagtcttaagtattcctccatctcatacacgctgtcaccaggaatatgtccaacgccgccggtcacaacccgcatcggttccccgtcatgagtctcaactacattaatcactctcttaaaactcatcttttttcctcctctgaactcacttttttatttgctaatgcgaagaacaagattctccacagtttgcttcatcattcatatcatcttccggcttatctatatagccgtaatctggtaacgaataacacttctttccatagcgaaacagtacaattgcgcacataatcagtacaatgctctgtaggagtcctacaagtgtaaacataccttttacagagttaattcctccggtagcaaccagggtatatgcagtaccacccagaatacaccctaccagaaccttctgttttttgggagcctcatcttctgctgaaagtccgttcacagaaagagtggcagcgactgacgccatcggatctgccagtgtacagaaactcaaggttacggtacaaaggaacaggattgtaatgactttgctgaaagggagagttcctataatctgaaatacagctgcctgcataccggatttattaacagcttcccatacatccagtgttcctgatgtttgtaaataaattgtctgaccgccaaaaacaccgatccagacaatgcagaaaattgacggaacgagaatctgaaccaacataaacgtacgaaccttgcggcctttccccattcgggccaggaacattccaatgactggcgcgtatacgatgaaggaagcccagtactgtacaatccaatcagcgaaccatttatcattgctggccatcgcatttgccatcgtggtctgtgttccccaatggtctacaataaatccaatggattctgatgtaatctttgtgataaactctgtatttccaaatagaaatacataggccagcaggaaaaagaagaaatacatacaggcggaagataccagcttcaaaccttttccaattccggaaacacaagaaagaataaatattacagtaacaaatattgctgcaaagagccagcttaccgctgactgaggaattcccagtgctgcttcaagacctgcaccaatctgcatcagccccactcccatggaattggaagtcgctcccatcaaacaaaagattacaacagcagtaaccagcgtattcaaccatttgattcgttttcccgtggcacattctacaattgaattaaacgacaaacttttttttcgattgtagcaaataattgcaaatgctgctccacaaatagcatacatacaatactgaacaaaactccaatcccacattgcctgtgctaccgcaaagattcctgctgtacgggttcccgcttcccccatagcggccggagttgtcatatagtggaaaatcggctctcccatggcccagaacaacaaccctgtaccgataccagaacatatggacattgcgcaccaggaagccatgctgtattctggttttgcatcttttcctccgattactacatctccgtatcttccgattaaaaacacaaccgcaagtatgataaacgtgagtgatatcagattgatgtatgccccaaaatagtcagccatggcataaagaagtttcgtcatgaccgctccaacctcttccgtccatatcacacctgcaaaaataaaactgataagtattacgattgccggccaaaatgccagtttatttatttttttaccatctttcgatttttgatccatccttttcccctcctaaaactaaccttctacccgtgctgcctttttatatgtgtatacgatatcaatcgccttggagcatacaaaagtgtatataacagaatacagaaatccggtgaaacttttaaggagaattgctcctatcaggattaccgtagtatccataacaaaaagcgcatttcccatattaatcctgggatttttcttctgaagaatttttcctatggcagttgttccgcccatcgttccaccggcccgcattaaaattccggctccaattcccatcaagattcctccaataactgccagtaccaaaccgtgctgtatgaacatagtcgggaaaaccggcagccaccagtcaattaatatcgatgtactaactataatcacgattgtataaatcagaatcttttttccgaagcacatcacacatacaagcatgatcggcagattgcaaatcagattaaccgttccgattgaaattccccaaagactgtgtgctaccaccgatactcccagaacactccctggaacaatgttgaccggattgatcaagatggcagatactacatatagtatacatccgactgtgagacctgccatctcttttgaaaaattcttcatacttcttctgactgaaaagcaatcatagaagcttcgagaggtacatcagcaggcagtgctgctacctgtacacagacacgcgcgggcttataaccgccgaaaaacactgtataagcctcattgattaaatcaaagtcttttaaatctcttatgtaaacatctactctggcgacactctcccgacacccaccgccggcctctacaatactcagcagatttttcagaaccagggttgtggcttccttgatttcataaacataaataccgtctttggtaagcggaatctgaccggacgtaataatcatatccccatatttgcgtccatggcaataaggccctaacgccggtgatgcttcagtacttaccagttcttcaagtttcattttccttcctcttttcctcattatattttatttttgtttcatatttctttaatacgtttcactttttgtatttctattttatataatacattcttttattcaatatgtcaatattatgtttcatattgttcccttgttcgtcataattaccaattatcgcaagtaaattttgtaataaactccaataattatttcaatatggaaattctaaaacggaaaagaacagacctccatacgattgaagcatatggatacctgttcttcccgttcgcaaaaatttcctattcaatattcagacagatgtaagaagtaatttaatttcagtcatcataaacaaccagtaatgcatccgcaatggctgctccgtcttccgtaacaaaaacaggatttatatccagttcttttaccgtatctttacactctgcagccatttcactgatttttacaaggagattggccagagcttctttatcacagactacaccgccgcgatatccattcaataaaggataagaagccaggttctctatcagcctttcagcctggagccgtgtgagaggagctggtgccagctgtacatctttaaacagttctacgaatacaccacccatcccaaccataatcatagggccaaaatctctgtcgttgttgacgccaataatcatctccacaccggccttcagcataggtttcaaaagaacgccttccagacgggcagccggggcattctttctgcagctatccataatagcggcatacgcttcgcgcagttctgcctcattcttaatattgagttttacccctcccacgtcggatttgtgctgaatatcactcgaatgtattttgaccgacagaggataacccagtttttttgcttcttcaacagcctcatcagccgtaacagcgactgcctgaggtggaattggaacaccgtgtgtgcttaagtaattcaggctctcaaactcgcttaagctatgtgaggcactatgtattttctcgggaattgcaggctgcattgtttcaaacgttttgacagcaaaatcaagaacttttttaagcgcattgcagccatagcggccagtaggaagcagcggtgtacctgctgcccttaagatatccgcgctttcctgatgccttgtatgctcgatgaacgggatccagaaaactggttttaattccttattctggcgtgcgattgaaactgcctccaccatatgggcaatcgtatcatcccagatttccggcgtaatcgtataggccaccacaattgcatcgacatttttatcctttgagatggcttccatcgcctgtaccataacgggagtattatagccaataccagctgtcatatcaaaggggttattaacagaaccgtagtcaggcaccagagtccgtaaatagtcttttgtcccctgccccatctctgccagttcaattccatactcctctgccaaatctgccattacaccagcctcaccgcccgatacattcataaacacgcagcgctctccctgaggatattgatgcagccaggaaaatgccgctgccagactcatcagttcctctaagtcactcgcttctactacaccataccgtttaaacacagcgcgcagtaccttgtctgcaccggataaagaaccggtatgagaagcagcaagctcctgagatttactggaacgccctgtcttcaatattactaccggctttttctttatagcagccttttggatggcagcaactaatttctctggctttgtaacaccttccatataggcagccactactttggtatcttcatcatcaaccaggaaatccagataatcctctacctttacattacaggagttaccggatgaaatcacgtgactgaatcccatattcggactgtccagcccaccgagaacaatctgaccactctgtgatatcattccaatattcccttttcgctccctttcttcgacgagaaaggcaaaagcaaaaattccgtctacaaaatttgcataaccagcgcagtttggtcccataatggcaattccaaggcggtctgctgcctcaaccagttccttctggcgttcttttccttccggtccaacttcactgtagccgctggcaaatacaactgccccgccacagttttttgccgccgcttcctctaatagtggaataattgtcttctgaggagtgcacaaaatcacaagatcaacgtcgccctcaatttccgagagggaatgataggcccgtcgcccaaaaatgctgtctctgcctgggtttaccagataaagtttatccaggcttttagaaaatttcaaataatttcttgtcgtatcaccgccaaaaccggctttttcgctggcaccaacaattgctatggttttcggttttaataatttattcagattcatgcaaaagcccctcttctcaatcagttgatcttctccgcattctcatacccagcttcaaaacactgcacatttttttcacttggttttcccttatgttcaaaataatccttcagggtatccgcaaactgctgtttatccatcatgccagtcgcggcgatcatcgcccccaccatgacaaggtttgctcctcttgcattttgcaattccgaggaaatccccattgcatcaattccaatgatctctaagttatccgggtaatctctctctccaaacagtgacttattaataatcactttaccgccatcggccacctggtcaacgtatgtattatatgcatcttcattcatacacaccaatacatccagcgtatccggataaggacttccaatttcttcatcagaaacaacgacacggcacagtgcaatgccgccgcgcatttcggctgagtactcgctggtccagctcacattcttaccattttcagcggcaatttgaattaatatctttccagccgtcaaaaccccctgaccgccaattcctgcaaacatgatatcagccatttgcttcacccccattatttgtatgatctacataaacctttaccgggaatacagtttcattctcttctttcaactttttcatcgaatctacaggagtcatcttccagttagtcggacacggagaaagaacctcgataatagaaaaacctttcttatctctctggttttcaaagcctttctttatcatcttcttggtctcattgatatgctgaggatcatacagtgctccgcgggccgcataggcgatcgggtaatggctgataatattcagcatatcaaatggttcacccgcagcacggtcatctcttccactcttgctgctgactgtcttatctcctaccaatgttgttgcaagacacatctggccccctgtcattccgaagattccattattcactacaatcatggtgattggaacgtttctctgggcggcatagcacgtttctgaaagtccaatcacataagaacagccatcgccggcatgaacatatacatttgcctccggacgtactttcttaataccggtcgcgacggcggcacaccgtccgtgcgggccagcgatgccgtcacagtttaatgtatcaatggaccagtatgcacaggcaatatccactacctgtacagttctctctactagccccagttcttcgcagcactctgcaatcaatctctgaataatcccgtgaccacaaccgccgcaccagcctacctgctgattaatcatttccggttttgtatacttcactgccataattagtaaacctccagttccttttcttttccttcgagtacccgtttacagtaatctacaattccctgtgtctttggaacatacttggatgtcagataagcatatacaggtacggagaatctggtagctaaacaaatgtcctgtcccatctgtgcggaaagactcatctccacagatattaatccctttacactgtccggaagattcttgaatgccttttctggatatggccaggcactgatcagacgaatcagccccagcttaagcccctgtgttctggcacggcggactgcagatttacaaattctggaggaaattccatatgccaccagcaccagctctgcatcttccaccataaattcctcccaccgctgttcattttcatgcataagcctgaatttctcctgaaccatgcagtcgtaatcatcgtaattcatggatctgtctaaatttgtcacctttactttgggttcatcaagtttcttataccctttaattgcccagtcaaactgatccttatcatgttctttcgcctcaggcagaaccaccttttcaatcatctgactgataccaccgtcacttaagatgataacaactgttcgatatttctcggccagatcaaaagccagatatgtaaggtctgcacattcctgaacggatgcaggtgtaagaacaatctgcctggaatctccatgaccgcctcctcgaaccgcttcccagtatgaatcctgtccttctgtaatttcaccatcaccgacaccgtatctcataacatcaatcaagactgccggcatgttgtaggaggccagataagaaattccttcctgcttcagatcatatcccggtcctgaagaacttgtcatgacacgttctccacaggctgctgcaccccaaagcatgctcatacttgcaatctcgctttcaccctgtacaaagactcctccgcgtgccgccatgttggccgacatatattcgagaatctcactctgaggtgtaatcggatatccggcatagaaacgacaaccagctcttaaagcagcctccgcaatcgcctcattgcctttcataagtctaaatttttcgcccatatcttttctttcctcccctgttaatctacagtgctgatggtaaatacgtaatccggacatatggtataacaacgtccgcagccaatacatgtttcctcatgaataccgatgatttcgtaacctttcttgttgatctcattcagcggctcgatcgcctgaacaggacaggcgccgatgcagagacgacatcctttgcagagacttacatctgctgttgctttagcttttgccatttctacctcctaatttgtttcatttttattatttatgtttcactttttattttgtagtttcataatatcactatttgtattatttttcaagtatttttgtgtaaatataataaaaaaatttcatttattctttttaacttgcaaaattctacagtatctcctataatgatagtaaatagtgtaacgctcgtatcaaaatacgtatttaaggaggattcacaatggcagaaggaaccgtaaaactagagaccatacaggccgtagacagggcattacagattctggaaacaataggcagggcgagcagcatgagccttgctgaattaaataaagaaataaaagtgaataaagcttctctttcccgtctggtctatacgcttgtacaaaatggttatcttgtgaaaaacgaaaaaaacggagactactctctgacgttaaaaacgtatgaagtaggactgaacgctgtacagaacttagataagctttctttaattaattcaactcttttagatttaaataatcgatgtggtcggatttctcagttttctgtggaagataacaatcaactcttatgtcttcaaagtataggaaaagaggcaatgtcattctctgtatacaccagcgtaggtcatcgttctccgctctacagcaccagtgccggaaaggcccttttatccacttactctaatggagagattattgagaaatgggacaagatgaatattcagtcactcacagaaaatactctgactgatctgcagttatttcttcaggatatcggtctgacccgcaaacggggatatgcgctcgatcgggaagaaaacgaatatcacgtattctgtgttggtgctgttattatggacttttccaataaaccaattggagcaatcagtgtcagcggcagcagtcttaccccacaggaggaagaggaaatcagcggcctgcttctctcttccagccgcaagctctccgggcttctcggatatgcaatacggtaaccatacagaaaaatgtattctactgaaaatgagtaaccgccagtttatgactataaaaactggcggttactcattttacacaaactttgtcctattataaatttcaccttaatttggcactatacccattcagaataaaacgaagtactataatcccacttccaggatattttttccctatattacatattcagacaagatacagctatatgatatgaaatttcgcttgttctagcacttgatttattctattttggcaaataacatcgcaattcgtaaagtaagttatttacatcaatgttttcggtaaaaaggccagttaaaataactgtttttataccgtctcggctaaataaatctggaaattctaatgccgcattttcaattttttctggcatagcagattttgaaagaactgaaccagcgggtatagttatcacattgctgtcctttgcgtttttgccagatacgatttctataaactgatagcgttcaatcaaatccgacttataaaagtacaaaagcccgtattccgttcccatctggtatccctgtttttctaataaaagcggaaacctgtcaatatttttataatcatcttcggacagagaatgactcataggtatgacaaaatatcttttctttcgtacataatattctattggctcaatagcgtttaataactgtttactatgttcaatcagtagttgatactgttcaattttctttatcccctcactgattgcctgcattttcttttttgcctgcatttttccatactctaaaagttctttcgcatgaattgtctgcccactgtcgtcagtaaaactcaaatactcctttaaaggaatatccaattcaatgcaggtctgtattgcaccaacaatttcaacttgcgagtaggtataataacgatagcttgtatcggagtctatatatgcgggctttaatacccctaatttgtcataatagcgtaacgagctaatgtgcacccctgtaacttctgaaatttccccaattgacaataaatgttttttcataaattcctcttgactctcacataatattagactttataatttctattatagaaaaatttttgtaatctgtaaaggaaacaggaggagattttatgatgccggaagtaataagccgccgaaaacactttatcatcaacgctgtatatatcacgatattgattattattgcaggaattatttttctatctgcaaggttcattatgccgttctggattgctcttttccttgcggctatcatgcagccgttgacacgttttttaggcaggaagatacacataaaaaagaaacatttagcaacactggtatggttttttttctatttgattatagggagtatggttgtttggatattcatggaggtatcatatctgcttgatgaagtgttccttaacctcccttcctattatgacagtacaataaaatctgcccttcattcattaggggattttctgaagaatatgttttctgtcatacctgcacagtttcgcccaaatctcgatatgatgcaaactgccattacaagcgccacacaacaatttgtttctaatatctcacaaaagggaatggttttagcaggcagctttttttcaggaataccatcaggctttttatcgagtttgataacaattcttctgtcattctttattagcacacagtatgacgaagtaataagctttataaagtgtcaactgcctgaaaaagcacgtggttctgtaagtgaaatcaaacaactgataacgagttctctttataaatacttaaaatcgactgttattttaatgtttattacaatggcagaactaatgataggatttcttgttattggcataagcaatcctattgggcttgctgttgggattgcattatttgacgcgcttcctgtatttggaacaggaacgattatgataccgtgggctgtcatggaattgataaatgggaattatactttagcggcaggggtttttgtggtttactgtatcatcgatattatgcgcaacatattggagcctaaaatcattgggacgcagtttgaaatgaaccctatcgttgcattaatcactgtttatttagggtatcagctatttggaattataggaatggtggtacttcttataacagtttatattctattgacttttcacagagtcggaaaaatcaaactttataatagcctggaaacactgcagacagacaatcaagaaaatttggaggttactcatggaaaataataatttagaacgggaaattacaacaggatcattgttgaagtttgcgcttcctacaattatcgttatgatcttttcaactttatatggcatggttgacggggtatttgtcgcccgtcttatcaataccgacgcgctttcttctgtcaacattgtaatgccgttgattactgtagcaacatctctcggaatgatgtttgcaacggggggaagtgcaatagccgctaaattgataggcgaaaataaaacgatagaagcgcgacagaccttttcactaatggttgcagctacatttataaccggcattgttattgcaatactgggaatagtatttattgaaccactactaactctcctgggcgcaacaaaagatatttactcatattgccatgattacgcttattccattttattacttcttcctaccagtataacaagcatgatttttcaagtattttttatcactgccggtaaagctacattaggaatgcttatcaacatcataagcggaatttccaatattgtttttgactatatctttatcaaatattgcgggtgggggatagccggagcagcaatcgcaacatctatgggatttgccattactacgattgcaggattaatatattttacagtcagccgaaaaaatgtgctttatctcacaaaaccaaaaataaatggcaaggtattgctgcatagctgtacgaatggtgcttctgaaatggtttctaatctttctcagggcgttaccctaatattgtataacaatgtgattattcgtatcgcaggggtagacggagtagcggcaattacaatccttttgtatgttactgatttattgattgctatatttataggctatgcaacgggcatttcgccgcttatcagctataattatggaaaaagcgagcataaccgcttgaaaaaaatccataacattagcttaaaatctatatgctttttctcaatagtagtattcttgactgggcagctaactgcaggtaatttagtgtctatcttttcgccagctggtacgcatgtttatgatttagcgatacaaggttttaggctgtttggtttttcctttttgtttatgggtatttcaatatatggttcagctatgtttactgcctattcagacggaaaagtatcagcaattatttctgtcttgcgaacatttgtttttataatcgccgcggtgctgctgttatctatcatttgggggatagatggtgtatggctgtcactccctgttgcagaattattaggtatgcttgttacagttcattatttcagaaagtatagaaacaagtataattatgcttaacagttaagcaaataataaaattaaatagtataactactatctgccggacgacggcaaagaaaaagccgtcgttgcgcagatcatggaccgattaagctccatcataatgtatttttgacaggatttaacagttatgcccatttttataagatgcataagaagcattatagaaaactgacaaaagaaggtaaaacggtttaaagacctgaaatattgattacttcttatactctcggttgtaccactccgcagacagctgtatttttaaatcaccgcccgccttgcgtcaggatgacacataattctccttcattaccagcagcgcaattccttcctttgcaggcagtccaatcttcacctttccattgatcccttccacagacagtcttcttgtcatttcccaaatatctataatctccactttgtaacttccgttttctgggagatgaagttctttttttcctggacagtaacgtccaaaatactctaattcatacgttttcccttccagcttcatgggactgttggctatagtataattatcctgtgcttccggcgacgctttttttaacagcctgtggaaaggagactccgtcgcgtcttccgttttttcgtcctgatttggatttacaagtacagcttcgctggctttccacggtcccggaagactgtacaggagttcctttaaaaaggcgattcgctttacgctctctccatataactggccgccttttgcccaccacaacacctcgttactcctgtcataagtctctccatgtgtacaaaatccgcctctgcatactgtccaccagaatcgctgcaccatttcaaaggctgataaattcccccaattgtacggaagatcaccttcataaccacattcatcaataatgatcggtattccgtattcccgcttccagaaaataatccggtgaagttctcctgactggatagaacagtgtgtcatccatgttctcttaggataaggcgcaatgatatcatgtatggaaataagatggacgtaaatatccttctccatcagtattttcccatattcatcccagtcttccagagacttttcgtacaaaacttcatactcgtttgcaagactccaccagaggtttctatatgcagacagacgagcaatacagtactccagataaacgcgcgattccatctgtgtgagttttgaaaatccccatctgtcatacggatggaacaaaattaaatccgcttctattcccagttccatcagctgtttaattcttttatccagcttttcccagaataccggatccggatcatttacctcccaggaaccgtcttctttctttaaaaatggataacaatctggttcattgttattataaggcattgattttggaaagacacacatgcgtattttattaaaaggtgattctgccagtgtatcaagagtttcctcctgaagttcttccgtttgatgaatccaggcataacacgtagttccaaccggtatataggtacttccatcctgatattgaaagtggtcaccctctgcatggacgacaccatgattctctcctcgcgctgccgtacattcaaattttccggaacgttcctcggttccaatcataatctggtaactccatattccttccatctgcggcataaaacgaaccatatattctccagaatggtttttaaataaccttacccgcttttctgccgtccctctcttaaatactgcctccccagcaattaagtccgtgacatcttcacaattcaatacagcctcaaatactccatatttctctatcttcttcataaaactcagccttcctcaatcaaatcattcctcctggaatacaacaccacatctcccgtaattcccaaaggttccattacaatgaactgcgacaaataatccttcctgtaacgtcccaaattgttgactacacgaatctccagaacatttttgccaccgatactataaccggttaagtcaaaggcatagggataggaaattcttcttccaacagaaattccattcagatgtacttctgcaatttcattcacctcctcgatcaccaagctcatctgctccaggcatgatgaaaattccgtgcggtaaatcaattctccggaaaaatcctccagttctgatattcggtccagatccgggagcgaatcaaactcccagatctgctgttttggtccacccaacccttttcctacttctacagtccagtgctgatttttaagactgaatgcatttaccgcctcaaatacggctgcctgtgataatacatttccaactttcgtttccttttcttccgctgtatttgtataaagaaccatcaattcccctttagccaaagtaatggaatacccctcgccctcccgaggaaggtccaccctcctgttttccatgggagcgtatccatgcagaggctggtccgtgggaaatgtgacatgaatgttcagattctcatacaggtcttcattaaacaacaggaagatttccccatcttcatggaaataatggtaataccttaaatatggaacctctctatccgtaatcaaccggtccgtttctccctctaatttctccggcagttcctgcaatgtacagacccttgagactgaatgcagcttattaagcaagccgatgtctccccctttttcgctgagagcctccgggagttcgtctataaacagaatgttcaatccgttttctcccagtcggacgagactttttataagcttttcaggaagccgctgcgcgtatgggacgatcagcgagcaaaatttctgcccatttacgacaatctgccccccgccgactgtcctgctttgggtcagcatatccgcggatagtatgtcaaactcaatctgattttcactcaaaaccctcgccggtttctggaacaacatgtaattaccggaccactccgcctccgcatggtagaggagacccgtattgcctccatgttttcctcccgacagcagaaatcccagcctgttggtgtattccgataagatatccagataagtgaactccggattattaccatgtgcatagagatgcggcggacagtccagatccggaaaatccttcatggaaaatgcatgagggacaaaatagttcacaccattggccaccatgtgatctgtaatccatttcatcagtttaagtccctccgcccagccgtatgcaccaaatacttcacacattgttctgcccttttttcttggatccaaatggcccagagaagctccaagcctggccaggccaaatgtaaagaattccccatcccagcctgtactcgtaaaggatttaaacatatggcggttctgacggggcatcagttgatgcagcactacatcaattcctgacatatcctgtcctgacatggacttaaaaaaatggcctgctccataccccagacgggcatgagcattattatcttctatcacatgaccaatatactcaattccccgctctgtacaccagtttccaatcacattagaaaagttttccgaatacattctgctgatgaaatccatatactgataccggatttcatgtgctcctgctgagtcgccaagaaacagcagcagcagccttttcataagctcctgctccgtaagatccagctctgcagccagcacactctccattccagctttccatggcagcggcatttcgtatcttccaatcgatgcatccgggcctttcacattgcccagacggggttcgtcagaaaaaaatcctttgatgacggttccaaacttctccttcaaccgttcataatgagggacgtacaccgtttcaagcaatacttcagcagcttctctctgcaatggattcaagtatccttccgtagcagcttctcctccctgatacgttgccgacagaagaaatacagaccattctccttccggtatatcccattttagaatgcctttttcctcctcatatggcaaaaaaagaatggattcttcgtcaatctcccgatctcccgactttcgcgccgccagtacacccaaaacctgtgtttcaccgcagtcactgtcacacaattctggtttttctgctcccacattcatgatattgggccggtccgtcttcagccatttcagaagaattcgcccattctttttcggacccacaaaatcgagagatcggacagttaaatacatttttctcagttgaggatatctttcctctatcatccctgccgcataaccggtaggaaaatgcttatcgtctaaaatccaaacatccattcccaaccgttcacattctcctgtaataaattctaaatccttccaccagggttcttctaaaaaagcttcatacggcctcgattccaggcacaccgctcccatcccacagcctgctatcttttcaagatagtcttttattacatttctctcttctccgtgcatccaaagaaacggcatcatatggttatcatattctccatttatcactttttcgattctgtccacaatttcacatcctcacgctatatttttttctgtaaagctcccttttcttataacttttcaagagattcctttccatttttgctttcctatgataatatgagaattaaagaaagacaatggcagttcacatgtacttttatatcatattttacgaaaggagtcctacatgcaaagactcgaatatctggatacatttctgcggcagcgaaaaccaagcgaactcaaatatctggaaactggagaactgtcaaaatcctattccgaaatgaagtatacggtgcagaatggtcaaaagctatatatcttcgatgggtatatcccacaaaatgaggattttaccattagaaggcacaatcgtttctcccctgtcccggagcatatccataacttcatagaaatcagttacgtctataatggtgaatttactcaaatcatcgatggaagagaggttacactgaaaaaaggggaactttgcctgattgatacaaacgtccctcactcaatcgctcctaccggagaagacgatatcatcatcaatattttaattacgaaagaatattttcgcaatgaactgctgatgaactcattcagcaaaggcatcatcaccgactttatcctggaagtcatttcagaaacagccaatcacagacaatacattatatttaaaaataaagaattcacacagattcactctctaatctgcgaaatgctgatggaaactttctttcctgccatcggttccagtgaagctgtcggccactatttgaatattttcttcataaagctggtccgcgatttcgattacgagacaaacgggcaaaccagcagacaggatactgaaattctggaaatccttaaatatttggaaaccaatatcgacgacatcagcctttctgcactagccaggaagttcaactactcccccaattacttaagtacgctcctcaagaaaaaaaccggaaaatcgtactcggagattattcttgaaaagagactgaataaagcaagagtgcttctaaccactactgaaatgaatattaacgagatcgccgcgcaatcgggctttaacaatccaacctttttctacaaaaaatacaaagaaaaatttaagcgttttccctcccagagaaagtgagagtcattttctttaaatcattttcccaatgtatacctggaaaacagcaggacaatcacatgtcatgccctgctgttcctttctcgcttttttaaccattctgccgcttttgctgcattctatcctaaatcactcgggcgtccgcatagaatcctctttctctgccttctatccacgcatcttctgtaatacagaacatatcacataattggatctcttccgaagagcttccaatctgaatctcaaactctcccttttcaatcttccaccgcatcgttctgtcaagaaaggctgtctgactggccttcatcacgaagaaaactcttttttcctctccagcctccagtgtaattcgtttaaagccagccagttccttaaccggtctcgttgtgctggcatacagatcacggaagtagagctgaataatttcatctccctttctgcttcctgtattttttattgttaactcaattccaatctgctcttttggaccaattgacttttgatcaatttttaaaccggagtattcgaatgtcgtataggaaagcccatggccaaaataataccttggagtatgtggcatatccacataatttttaaatccaatactttctccctggtgataggcagagccgttcggatggttatagtaaattggaatctgacctgcacatctggccacggacacgggaagacggccgcctggattatattctccgataagcaccttaacaactgcttccgcccccttctctgcaggattccatgcctccagaatcgcatccagatattggtctgccacatcactggatataggtcttccatcaaaatgaattcccaccatcggtttgccaagctctgctgcccgctggatgaatgtctcctggcaaaatggcagattgatattggttccatccacaccttctcccatagaggcaacagaacaggaaccattctttccgcccagcgtcatgattaccagatcggcctccgccactgcctcaagcgcttcatcaatatgggacaggtcatcgcccgcaatcggataaccgtacgcgtaccggatttttgcctccggtattcttctgcttaattcctccaggaaattccggcagtccggcttgagttgtcttagcacaccgtcgaacgcctccgtctcgtcactctgaatctgtgttcccggaacggttatcatctcccgtccctccacactgcctgctttcataccagcaatggaattagccacagcatgtaccgcttccatcatactgatatgcgtatatccgccgaagaaacatctggcattttgtgcatggcagcccaccactgctattttccggccgtttggattgaatggcaatacgccattgtttttcagaagaatcagagattctaacgccgcccgcagcagtatgccctcatcttccttcctgtaaaatgcctcctgaagcgcttcgttttccagcgcatatggatgctcgaaaattcccatgcggaactttgcttccagaatacgtctaactgcacggtccagaatctccatatttgctcttcctgatcggaaccactctttcaattcttcgttaaacccaacgcagttctgcatttctacatccattccagcttccatacacataaggccggcttccgtgacgctttctcctactttctgtacatgaaagacatttcccacggctccataatcggctgcacagactccatcaaaccccatctcttcccttaacagcccggtcaacattttatgagaggatgacaatggttctccgttaatagatgaatagcagggcataattcctctcaagtttgcttcgctgatggacgcttggaatggttttccgtaaacttcatttaagagtctttccggaatgtcacagttagccccatggattcctccctgggaattatgaaatccaagaaaatgctttgcaacagattccgcctttctaccagccgtttctccctcctgaacgccattcgtataagcagttccaagcgctgccgccagtgtcgggtcttccccatatgtttcgctctgcctgcccattcgggagtccctgctaatatctaaaaccggagccagaacctgggtaataccgcaggaaagttcttgtctgctcacaattttccccaacgattcttccagctcagggtcccaggaagaccccctggcgattccggacggaaggctgacagaattctgtataaacgggccgcatagtccttccatatgaaaaactgccggaacgtggtgcggactgttctccatgaccatcttctgaatctttcgctgccatgcggccgcttcatccaggctttttaatttcctgatatttagagtactgacctggccaattccatatttcgcctgctgcgcaagttcctcccagttatcccttcggggaaacaggcagttcacctggcccattttctcttccagactcagcctggataaaaggtcagccgcacgctcttgtggtgttaaattcacatttaaatatttttccatgctgcactcctttccttggtctgttacacatctttatccgtggttaagtacgtgagaatggtactgattccaaagctgacagcaaatgtcacaaaatagccaatgattgacctggggtttccgctcggatccatatgagcaccaaacgtcaggattcctcccaccgtagctgccgcaaactgatttacacctaatacagagcataacggacccgcaataccacctgcaatcattgcacagataaacggttttctataaggcagcgccacaccgaaaatcgctggctccgtaattccgaaaagtgccgatgtcatcgcagtaaaacctatggattttcgatctttcttcttcgccttcagtgcaaatcctaatgcagctccggccaatgcccagacacccatgcccagaatcgggttgaagctgttggaaccctgtctgattgtaatatctgtcaaaatcgggatgaatgcgtaatgaagcccaaacataacacaaacctgccagaacgcaccaaatatcacacctgcaagcagaggacttaaattatagattcccatcgtaccgtttgcaagtacttcaccaaccattgtaaacaccggtccgatcactaaaaatgtaaatggaaccataaccagaacaagaatgattagcttaacaaattccagaaatgccggtatgtatttatcaagaaatttttcgaattttccagcaagcagtacgctgatcataaccgggaatatggaattgccataagtcactgaggcgactggaattcccaaaaatgtcaggcttccttcccccatgactgtaacgattgccggaagaacaagacttgcaccgataacggaaccgacataaggattggaacctgcgtacttagccaccgagaacgcaataataatcggtaaaaagtataaaaatccatcattggcagcagacagaatcacataggtaccgtctgtcgtattcagaatccctgctgtcacaaagattgccagacagcctttcagcacaccgaccgcagccatggtcggcaccagtggatagatcatattcataagcgcccttgataatcggttaatcagcttctccttatttttcgatttgatgctgtccagcttttctttcacctcatccatatccgtctctttggaaccgttacctaaagcattctgtacatctttataaacatctttcaccgcgttaccaataattacctggtactgtccaccagctctcatcacgcccataacctttggtgtccccttaatcatctcgtcatcagccagcgcctcatcagccagctcaaatctcagccgtgtggcacaatgggtcacactgaccacattggtttttcctcctaccccttttataatttcctctgccaactctctaccattcattttccgctctccttttccttatatctccggattccattgagacttccattcaattttgggaacatcctcttcaaatgtaaccggcagccacacgtattgcgctatactcgtattaatgttccatgaacttttttgatgctcccgatttaaatctggcacccatctgtcgccgaccgcaagataaaaatctttctgaggaaccgaaaagacactgctgatttgggaattaaatgtattgccagccttatcaccaatgcatgggtctccggtaatgtaccatggcccatgcatttgctccgctctggccgccaatgcacggttcggataatacccagttgtaccggaagtaatcatatagtaccaccgtcccctcttgaatacagccggcgcttcccgtgcaatcggcggcccgatgaaatgcagatgggtcgaataatgaccggttacgttcttataatcatccgccagatcggcaatcacaatctccgtgtgcacctttccaaaaatgagaaatgcttttttgtcctcatcgacaaacaaatcaaaatcgccgctgctcatatcgaggggaacaattctgtctatcagcttaaattccccggtaatcatcttcgatgtggcaattcccatatactgatgcttccagtttcttggttcctcatccgagcccaccagcttcatccacatgacatattctttatttttttcattgtaaatgatatgtggcctgtccatgattctggacggatgcaggggatgtctctcatcatcggctgcctttaatatcgtattttcaaatgtccagtttatcaaatccttcgatgaatagcagttcacaccattatgccagactccggaccctgggactgtgttcactttattttccccatagaagtaatatctgccatccacttcaattatgcttcccccatgagcctgtattctgtctcccctgctgtcaaaccacggtcttcccgggattattccatattccacgctttctcctcctttattttgagcacttaactcatactcgcttcgttaaccaaagtatacccttttgctccggttcccacaatatcagaacaaccttatttttatatcattttatacgatatcaggccaaagaaattccccggctctgaataaccgaaccgggggatttctttggcctgtcagcctctcctctctttttcgttttttaacctgtcgttttccgcttccacattcaggaatgacagtgtgatgattgccaccagggtcaggaagacaagagataataaatagccatgattgatgaatttaagcgcggcacaacgtttgaactgtcggacttgcaggtgccaaactgatacagcgtgattataaaagaaattacacacgggaaacactataataagcctaaaaaataaagaaggaggacatttcaatgcatgagcctgctgaacctccttttctttcatattacgactgctgttccctaccgcattcccagtgaggctgaactgaataaagcgtatatgaagacaaagaagatgcgtagtatcctttcctatatagaagcaaattatcaggaaaaactgctgctgtcagatgtggcacgtcacgagcatctgtcagtgacctacttattacattttttcactgaaaatttcggtctcaattttcaggaatatctcagtaacttacgctatttaaacaatgtgtttaagaaaaactatggttacccccagacaataccgtcataattttgaaaaagcaagcctgcccagacagcagaagtccatgctgagtacacagaactttctgtccaggcagacctgccttgttttgttgaaggattttggaatttagtgttatggttaccgaataacactgattatatacttttaatgcgatagcaattttatttgtgaatatgtactgattcagttccttttggaacccttggggagtccaggattttgtccgcccccattcaagatcactattggtacatttcagactctttcgcagtacttatagattgtgtatttgcatatgtttacaatggtttttgtgtcaaattatcttagaagtctgataaaataccgtctcatattacaggtactggattcttgattagagttattttagggtgtattgatgttttttgctatccaatcaatcatctcttcttcagtcatatttagatcataatacatatagttatttgaaaaccattcactaatagttcctggcgtactattgaaataatattcttctaagatttcttcacatccttcgatggggccaagttcaattgtttttataacagggttaccatctaaaactcgatcaaaaattagtttggttttggtatatgctatagggaaacgttcatcagtttgaggatctttgccactccatttaactgtaacaataatactattatcatcatttattggagcattgtcaaaagtaccacgtgaccctaaaaaagctacataacaggaaatgtgcccggaagctttcccagcttctattttatcaattacgatttcttccatcacagaaccagaggcggctgtcggaggatggtaagaaggatcaaatacttttccaacaaaatatgataaatattcatcagtttcctttgaagtgcttttattcacttcttcattttcagacgtaacttgctcatctgttttgtttagctccaaatttttatcttgaattcgtttcgtttcgggattccacatattttcttgcatatctcccgaattcttgttttcaacgatatttgcttcagaatatttattataatcgtttcccaaattcgctgatgctaatataaatattaatataataatataaatatagttattcatctttttccccgttttattataagcgtttgataaaagccgtaattctttaaataacctacttcttattaacttttttcattttagtagtgtgcccaggctatgagaccgctaattgtaaaaaacttaagaagccgccttatgtctgtgatggttgcggtaaaaaggcacattgcgttatgccaagaatgttctattcatccaagtatgctcatgatgagtatcgtagcctcctggctgactgcagagttggtattaatccaactctgcagtcagccagtctatgaacgacctgctcgttcctttaattaaggataaggcgagcggtacgctataagaaacgcagaaaaccgactcaaaccagtgccaaagaccattcttatcgtaaatgccataactacgaggtttttcaaaaatatatgaaagaacatcctgataccaatgttgtggaaatggactgtgtggaaggtaagaagggcggaagccgtgttattttgacctttaccttgcgtaactaccatcttatgtttatggtccatttggaatatcaggatcaggaatgtgtgctaaaagtttttgtatggcttaaaacagtgcatagaaaaaaacctttaaaactttttatccgttatcctcacggatggcggttcagaattctctgcccggaaagagatggagatatttttccttcctccaaagctactgacggcaaatgtccataccatatatcagaaattttattattaaattttacttttaactgctctattacctgttcagaaagaacatgcctggctcccataacaattatcccctgcagcctaccattacaggcttctacctctggccgatcaaataaaatccccagtttttcatactcaaaactggttaataaaaggaatatgtctcccagtctctccagctatcaaatggtcgcattcgcctcgctaacatgtcagatcatatagattctttcctgtatattgaggcatcgcgccttttcgttccttcccacccgcagcctcaggaaataattggagtgctaaattaatcatttcaccagggcacattttagaagtaataattttctctctaaatatattcctctgtcgctgggcgagttgttctaacagccaggcgagcagattcatttcctgaacctgtactttgactggtaattttgttcggaaatcaaaattatctattctagcacatagacaatgggcagactttactggtaagaataacgtttgccagttctcatgatacaactgccttatttcttcatccgtgatcggaagcattaactccatagaatttttttctattataaacattattaattttcctccaaatcatgccaaatagtatccgcctcagtcttttgccatttagctccgtcgtcattagaaggcagacacaagctatagataaatagtaagaaatataaaatataacgttattaattcttttactccatctaatatccaactccccttacagtcttaattaatttaggatgttccggatctttttctatcttcttccttaatctgctgacctgacatataataccgtcatcacttccatgatattcatcttcccacagcagttcataaatctgatttctggaaataacccggccttcattttgagccagataacataagagattaaattcctgctttgtcagatccaccgttttcccctccatcattaccgttcgggatggtatatcgatagccagtccatttcccaaaaggatggaacgggaaacctccctgcttgggagcagttgtgtaaatcttcgaattaaggaattggcataggtcgtcgcatgatttccaataatttgtataactccgtttttgaggaacctgtgtccagaattactaattggaaattgttatttatgtaggaagccaggccctcatgaaaactttgtgtgtagaatccttatctgatccagtatttccccttcaaacgggcgcagggtatttatttcgttttgaaaacagtccacttttctcaaaacttccattacatcaccatcctctcatgtttttcatgattatcataccacaaggcaacaaaaaaagtagtccattccaacagatcagttcacaccccagttaagtttatacttccgattggccaccttttcttgccagaagcattatatttttttcactcttctcatcctgatccgattatataataaccaggaactttttctttgctgtaacagcagtatttatcttatctttctgtcataatctacttaaattgggtacttattggggggtcaccatgaccctggggggagttctgccaataagcagattctcccctagtatataataatgctgcttccggtctcctttcctgtaggttagtcccatttattataaaaaataatagttggagctgcttcctccgttttcccgtctgcggcattctcttcgaatccatccggccttttctaaatcaaccagagctcgctttactgtacttttcgataagttcagctcccaggcaatggtaccaattgccggaaaacactttccttctccatctttgtgatcccataaatacatatacacacaaactgcccgatgaggaagcccagactgatataagtgagtaaaataccccatatcactctcctaatctacacgaactggcaaacgccgcacatgttcttttcttgataatggagtcgcccgctcgacctcaacactagtattagtatagtccatgcatcatgacttgcaaatattttttcgaacattcgtttgtttttatgtactcttgacaacattttgtatttatattatattcatctattagaataaaaaactaaatattagttagtgctccactacaaaagaaaatcttataggcataaaaattgatgtaatcccaagtaagtttaatgtgtagtagcgtttatcaagcgcttataataaaaataaacaaaggtgaaaaatgaataactatatctatatcatattattaacttttatattagcatcagctaatttggaaggcaatcatattaaatattctcaagcaaatggtgatgaaatcaacagttcagtagttatacaagatagtgaatggctacctgaaacaaaggtaatgcaggataaggagttggaattaaacggaactgatagtcatgcagttaaacctgaaatggaagaagcgaatagaacgttttcaaaagaatctgatgaatatttatcatattttgttggaaaagaattcgatccttcttaccatcctccatatgcagcttctggttatgcgaatgagtatatcgtaattgataaaattgaggctggaaaagcttctggaaaatatacaagtcatataggttttatatgggaaactagtgtattttttaacactccaataaatgatgacaacagtatagatgttgtaaataaatggggcggcattgaatttaaaacagaggaaagtttccccgaagcatacaccaaaatgaaaataatttttgatcgtgttgtagatggtaatcctgttataaaaacaattgcgcttggtccagtcgagggaagcgaaaaaattatagaagaatactattacttaagtgagccaggaactattcatgagtggttttccaataactatatgtataattatttaaaaatgtctgatgaagaaatggttgactggataactaaaaacatcaatacaccatggaaataactagtattgtacaacactcattatctctaacttcggcttcatgaggtttaaaatgtacttttactctttcgtaataaatataagaaccagttagcacccgtgacccccttataacctatttttgtaaattattttaaattttgaaaatattacctgagaactattaggatagtaaaatcacctagacaatccataatactatgattctatatatctttttctttctgtaataaatttattatacttggtacttcttggcagttcatcatgcccccggggagggttcagctggcaaatggtcagactatcctcttgttagtatttactaaatcacgctgttaggacctcgtatcaaaattattttccggcaatggtactgattgtcagaaaataatttctttagtttttattccattcatgaataaaacttttatattttctccttaaaattcatgtccttaaaaaaagaagtactgcctacggcagtcccccctcatcgttcatatcaattacaatttctgtatacttttcatgattcttattccatcttctagtcccttttaattaagtaaatccagatcttctccacacttgtcaatgaaattgtccaaacaaacctcgtcggctgctcgttgttccccagtcaaaactctaagctgttcctccatattgcgggcatgcctttctctctcttttatcacattatgataagattctttgtacttttcctataacaaaccgttcattctctcggtcagcagttcccctaaaattactttctgtaattccatcatctcatactccttcgattttacactatcgaaagagtctgaaaaagtctatatacactatcaccgaaaaatgaggcgtttttaagcaaaccacctggcaggtgacaaagttgtgttttaggcgcaccctagctttttagaaaaacgtccacattgcgggcgtttgtgggggagaggaggccgttccggccacctccctttaacctgcacacaaatcgaacggcagattccccctgaaagcatacaatttaataccagtcattactgttttatctcatttatcacgcctgactcaaatcgggccaacaagcccgattactcctgccatccggtacatttcgtcctcggtcttataatggcacacagcgccaaatcattcgtcacacggccatataattgtgctgtctaccaacataccgttttaagcattctacaaaaaatgcaattgctcaagcaatatgaattgctcaaaacaattgcactctgtcgcgatatacggtaccaggcattcccctttcattctaaagcccaaactgtatattccctcatctcgtcttattcttccatcgtctgttcacattgctcacaatactgatgaagcttctgatcctgcttaagttccctgcatcgttccagtatcattgaccagtccttctctccgagttcttccggtcgatccattttcagtactctatcgaatttcacatctgtataccttactgcttttatcgctgcctcctgcaaagtctcatcaaactcagaggtctgggacgggatatctttctcttccgaaaaagcatggtcatgatccatcaacggatagagcccttttagtttaccattcctattatccataaaaaatccaaagtttgccccatgccggtcttcatttcccagaatataatctgccacctgcatgctgtaatatctgtcaggatccttttttctgataaaatcatactcattctcatcatgataactgcagtaaacctggaaatcctcccacggaacgatagctgtttcctcagaagaaatgatcttacacttaacgattttctctccactatcgtgaattttcttgatatgagcctcatctgcgatctgttcaagcctgtacgagtctgcttccttataagttacatgagggactccaagagcatctaaaattttactggctgccagttcttttttccctactttgtacagatagagcccatcgtcttcccggatccaggctttcgctgccattccctgaacggtgagttccggtgtatgaatcttctggatgatcggccagaatgtcttgctcactccgagaagtgccgttgcagacaccgccttttccagcggattccgaaacaggctcacctgatcccaggtaaggtcctctccctcttcttttagccagtaacagtctgaaagcgaggcaaaatggaacagcctggcaatcatatagggattgctctgactgatccgaaaccctgccagcagcttctttgcattggtttttccgatattcatcgtccggttttctgtccagccatgcatcacatcgtcataattaacacctggataacgcagggatataggaagcaaatcgtaatctaaaatcctgcagttatagttttctatttccaaaaccggtctgtctttcagcataatcataactttatccattacggaccacctctcttattttacctgcgtaaaaagtctgtgtgtctcattataccatttcttctgcttatattctatttttttatgttcctcaaaatgattttctctcgacaggaatcaacagaaggttccttgaaaagttagtacctcaatcaaaagtcatcttatacaccggtatacacgaatcatccctcacccatttatagtaatcttcaatcggacagtaaccggccagcatcgctgaaaagtcaaaaatccgcgaaacttttactccgatcaaatcaatctgaacttcatagtgtccctgatatattttctttatccttgtattcaatacattaaaccattccgtctttccctttctgtaagcctcctgtcattcaactctacgatcgtcaccggcatttcatcgccccctatctggcagcaaatgaacctcctccagggagaaatccaaaagttccataagccttatcccattaggttgtatgtgtaaccctcttcctgattcaatggaacgaaagaacaaagaactcccttttgctccacacatatatctccaatctcattttttccctgatcaccggaagcagataataaaacaatttaaccaaccaattatcttcctttatccattttctatgctctaaaataattacacgccaatttcgacatatgctttaacaatcctcataaaaaagaccaagcgaaatatttccacctgatcttcttcaaaaacttttattttttcggttattacctcaataaccagttagttaaactctatcctgtttccataaattactttctattttctccgctccccaaccacactcagttaaaaatctcttccaaacacccgaaaaacagcccctcatccgcctgatatctattaaaggccctatttccttcttaaaaacacagctcattttcgctcgaatttcggccatttttcgttctgaacccactttatcttgtggtcttccctctattttccttcttcatccacaagtgacatccgacagcacacttcgacattccccgtccccggaaacatatccaccgcacaaaccttctccacctgataccctctctcctgaaacacgaccagatccctcaccaggctcgtaggcttacaagaaatatacacaatcctcttcacgccatagtcgatgatcttccccagcgccttcggatggattccgtctctcggcgggtcaagaataatcaaatccggtttttccccgatatcatcgatgaccttcaaaacgtctcctgcgataaactcgcagttatccagcccgttcatcctcgcattctccttcgcggcctccacggcctcttccacgatctccactccgactacctttttggcgaccggcgcgatcatctgagcgatggtacccgtcccgctgtataagtcgaacacgaccatatccttcgtatcgccgacatagcttcttgctttatcgtacagcacctcggcccccagcgaattcgtctggaagaaggaaaacggagatatcttaaactttaaccccagcagctcctcatagaaatagtcctgtccatacagaatatcagtcctgtcattcttcaccgcatcggacagactgtcattccacgtatgaagaataccaacgatccggccgcttaacggaagggaaagcagcagctttgcaaatggcttcaaatccggatcctcctggctcgtcgtcactaaatccaccagaatctcgcctgtcttaaccgcgcggcgcaccagaagatggcgtaaataacccgtatgctgcatctttttataaaatccaagccccagcttctcaaaatactctttggaggcctttaaaatctcacaaaaatccggattcacgatctgacactctgtagtagtcaccacatcataaaagcttccgcgccggtgcatacccagtgccatcggaccgtccttaaactcatcgccgaatgagaactccatcttattgcggtatccgccggactgcggacttcccagaatcccctcaaactcataggaatcacagacgctgtccagcaggctcttaacctgcttttcctttatctccagctgcttctcgtaagggatcgtctggtaaatacatccgccgcaggcgccgaaatggacacacggcttttccgcggtctccagaggtgacttttccaccacctccacgatctttccttccagccgtccgccccgcttcttcgtaatcatcacggacaccttctgtcccggaagtgcgtgcttcactgtaatctttccggattccgttaccagtgtccctttatccggaaaatcgaatttctctatagtaccttcatatatctcgccttttttcacgtcatctgctcctgttctcgtttattcccgcaagcaacgagccaatcatccaacatcgttcctcactgccctcattcctcaccactctcactcgtctccactctcactccccaccactcttcactcctcaccactcttcgtccctcaccgctcccgccccgacagcgtcaaaaagcgtgtctcaatcgctgaggcacgcttcttttttctaaatgtccttcttactgttcagaaccctcgcccggtgtgtcgtcttcgaagaaatcatcatcgaaatcatcgtcgaaatcatcttcaaaatcctctaaataatccggtgtgaagaaacggtaaaccgcatacgcaatgccggcgactgccgctacagcaccaatgatggcaagtatccatagaatacagtttttcttcttttcgtcttcttctctcttgtgcagcaactcgttcagtctgcttgaattcacgagttcctctactctgttcatagcttctttgctcatcgtatcgaatctgttcatatcatccacgtcctttctgagagcctattccataaaaaatatgcggcagaaacgaaatctttctgtctgtcgttcttattataccatcatctttatgcttttactatcttttttgcttttttttatttatttcagtttttatccggttacagttcacagccccgccgtcctctgcttcccggtctgccccgtctggcttatgcgtggtttccagttcaagtttcggggataagcacttctaaacgtgcagaatttttctaaaaaccagggaaaattcccaaactcgctgcgctcagacaggtgggaatttcccctgaacgaaaaatcctgcgcgttaagaattgctaatcccctgcaaagtcactggaaaccacgcataagccagacggggcagaccgggaagcagaggacggcggggctgtgaactgcaactttatccgtaacggttcagatggctcaccttcttgaccggaaaagctgatcagatcggtttcagcttcgcaaaggacgcaaacatcttcttgatccccgccttgtcaaaacagacggttacctcgtagtcttttccgccatccttgatctccaccacgtttccctcgccgaactttacatggcggacacggtcgccttccttataatccagagcgcctgatttctctacggtaaatgccttgccaaacgccggtttctgaaccggtgacgcagtctttgacgcataggcattgctgcccggcccgaagctgctgacacccgcggccttatttccccaggtcgtcggtctctggccgccggaagcaccgcctccgttacccgtaccaccgcttccggaactgccccaggagctgccgcctctggcatttccgccgccctggccccagggcaggtcgctgtcgtcaaagtccgaagatttccggaatggggacagcctcggttccagcttatcgcattccagcaaatcggcaggaatctcttcgacgaaccggctggtcttggagtaacgggtctccccgttgatcattcgctgtttagctcctgtcagcatcaggaaatcctgcgccctggtaattccaacgtagcagagacgccgctcttcctcgatctcctccttgtcatccgaggagatcgacatcatactcgggaacagtccatcctccataccacttaaatacacccgcggaaactccagtccttttgcactatgtaaggtcatcagcgtcactctgttttccgaatcatccatccggtccacatccgcgaccaatgcaacctcctccaggaattcggagagtgttccctcgtcgtgatcccgctcaaaactgaccgctttattgatcaactcctcaatattctctaaacgtgtctgatactcgatctcgccttccgcttccagctctttctggtaacccgactcatccagtacatcctcaatcagctcccggatcgagtagtcctcataacggatcctctccctgaaatcctcgatcagcgccgtaaatttgagaatcttatccgcagcctttccaagccccggaaccgcctgggcacggcaaaatgcgtcatagatactgaaatcgtgctccgatgcaaatgcctggacctttcccacgctggtgccgccgatccccctcttcggaacattgataatacgaagggccgacagatcgtcccttccgttgtcaatcgtcttcaaataggccagaatgtccttgatttccttacgctgatagaagtttacacctcccaccatgcggtacggcacattgcgctgaagacatttttcctcgatcagacgggactgggcattggtccggtaaagaaccgcacagtcctgatagccgcattcgctgttctgaatatcgcgcacgatggcgtctgcttcctccgctgccgtctcaaactgcttatactgcaccagaggcccttcctcgttagccgtccacagcgtcttggactttctcccccggttgtggcggatcacctcgttggccgcatttaggatattctggctggaccggtaattctgttccagcttaatcaccgaagcccctggatacgacttctcaaaattcaaaatattaccgatattggctccccggaacttgtagatggactggtcatcatcacctaccacacaaagatttctgtacttaccggccagaagactcaccagcttaaactgtgcagtattcgtatcctgatactcgtccaccatgatatatttaaaacgctcctggtaataatccaggacctccggattattctgaaacagctccaccgtcttcatgatcagatcatcgaaatccagcgcattattcttcttaagctggctctgatactccttataaatctgagccaccttcttctgacggaaatcgcctcccgcattcagttcaaactccgcagccgtcaccagttcattcttagctgtcgatataaagcccagcatagccctgtctttataaagcttcggatcgatctccagcgtctttaacacctgccgcatcagagtcctctggtcatctgaatcataaatagtaaaattcgtcgtatatccaaggctctcaatatggcgtcttaagattcttacgcaggaggagtggaacgtactcacccagatgctctctgctccgaatcccacgatcttatccacacgctctctcatctctccggccgctttattggtaaaggtaatcgccaggatattccacggatttacccccttctcctcaatcaaataggcgattcgatgggtcagcaccctggtttttcccgagccggctccagccagcacaagaagcggtccttccgtatggaataccgcttctctctgtacttcattcaatgtatcgtaaatgctcataaacgtgtaccgtcatttcctttcgtcaacctgttatttcgattcccagatattttttgatatcctcaagctgttccgtcgcaagacggcgcccgtcttcgtagagtgcttccagcttctttctgtcctgttccgttctcgacacggtcaccggtttgtcgggacggatcacgtagattctgcccgccttttccagttcatcgatctcttcctgcatccggttgtaccgttccggagcctcctccagagccttcaaaagccggggcagcggtttaaaataccgttcatacgcccgtctcgtccatttatccacaggcttttttctgtagccccgattcctggtcagtatgacaatcaccttttcatatccctcatcgatagctctctgataggcgatcggcatagaacagccgccgtccagatatttcttccctcccacgtcgatcatacgcgacataataggaaggctgctggaggccttcaccgcctctatgaaattctcacactctccttttccgaaatattccggttttcctgtcttacagcgggtagcaaccacctcaaaccgctgcttcgatgcctcaaaagcctcaaaatcaaatggaatcagcgtctcgctcaattccccaaacagaaaatcaaagttaaagatcgaacggtttttcaccatactgcgaaagctcataaaccgtttatcatttacatagtctaaatccacccggatcgttcttccgatctgtttgctgatatagctcattccgcacatggatcccgcagaaacgccattcacataggacatctcgatcccctgttccataaatacatccagcacgcctgccgaaaatactcctcgcagagaacctccttccagtactaatgctccttctgtcatgtcattcacctcgcatcctattttattgcatttccccccgcgggtcaatccctttatgaaaaagcaagccaatatctccatttccagaccttccgcactttacaaaaccagcctacagaaactggctctgatacagctgataataagcccctctcttctccatcagctcctcatggcttcctgcctccatgatattgccctggtcgatgacgaaaatccggtcggcctttcttatagtagaaaggcgatgggcaatgacgaaggacgtacgcccttttaagagcgcctcaatgcccttctgcaccagcagctccgtgtgagtgtcgatgctggaggtggcctcatccaggatcaggatgcccggcttcgacagcatggttctggcaaatgccagcagctgccgctggccgatggagagccgcgcccccctctcactgatctcggtgtcatagccgtgctccagcttcatgatgaagtcatgggcgttcaccgccttggctgcttcgatcatttcctcgtccgtggcatccaggcggccgtatttaatgttatatttaatggttccggaaaacaggaaattgtcctgtgtcatgatccccatctggcttctcagactcttcagcgtcaccttcctgatatcgtagccgtcaatcagtacccgcccgtctgtcgcctcgtaaaaacggctgagcaggttcacaatcgtcgtcttgcccgctcccgtggggcctaccagcgcgatggtctccccctggcgtatatggaagtttacatccttaaggatcatgcgttccggctcatcatcatacgcgaaggaaacgtgttcaaaatccactgtcccttcaatatccggcagttcctccgctccctcacagtcacggattcccgcttccgtatcgatgatgtcgaaaatacgctccgccgccgatatgttggttgtcagcttattataaaaattggcaaggttccggatcggactccagaacatggcaatataggtagaaaacgcgagaaatgtaccgatgccgacctcgcccacaccgatgatgcggatgccgataaaatacagcagaaatccgccgagcccccaggtgatctccaccaccgggccgaatccgtccgccacaacaacggcgtcgataaatgcctggtaatgctgcttaaccagatcgtaaaacacggctctcgtctcccgctccgccgcaaagctctgaatcacccggataccggaaagatcctcatgcacgtaggcatttaaattggaagtcttttttctgtagatctgccaccgcttatgggccgtcgtctcaatgaccagcattcccaccaccagaatcgggagggtcagcaaggccgccatggccagccggtagttcttgatcagcatgatgaccgcgacgcagaccacggtaattaagtccggaatcagctgagtcacgctgtctgacagcacatcctttaaagaattcacatcgccgataattctggccagtatttttccggtgggacggctgtcgaaaaatccgaagctcagcgtctgaatatggcggtacagctcatctctgatatttagaagcacctggtttgacacatccgacatgatgtacatacgaatcttggtccccgccaggaaaaagagaaacatgaccacggccagagcccccagcttcagaagtcccttcacatctccggacgccacacagacgttgatggcatactctatcataatgggcgtcgccatgctgatagcaatggttccggccataatgagaagcactaccgatatttgctttttaaagaccagaaggtacttaaacaaccggatgagcgtatcctttttcagtacttccttctgttcttcgtcgattctgcttgtatttactgacatggctggccctcctctccatgctgtacctgataagtcctgtaatactgcccctttttcgccatcagctcctcgtgggtgccgcgttctatgattcttccgccctccagaatcagaatttcatccgcatggcggacggcggaaatccggtgggcgatgatgatcttggaactgtccttctgcgtctttaaacggcgctcaatctccttctctgtctccatatcgagtgccgacgtggagtcatcgaggatcagaagcggcgttctctttgcgatcgccctggcaatactgattctctgcttctggccgccggaaagtccgacgccccgctctccaatcacggtatcgtacttttctcccagattcataatgaaatcatgggcctccgcgcagatggacgcttcctccacgctctcccactcggttgcgtcccggtttccagtcttaatattgtccgtgatcgtgtcggagaacaggaatacatcctgcataaccaccgtggtctggctccttaaaagggtcagaggcagcttccggatatcgatgccatccagcagaacttccccgtttgtcacgtcgtagaatctctgggttaaattgacgatggaggtctttccggaaccggtcacccccatgattcccagcgtctttcccttcggcagggtaaaatcgatgtctgtcagaatcctcgaaccgtataaatcaaaatccacatgcttgaactgaagctctccctcgatcttttcaggaaccacaggcgcctccggttccttgatgtccggcttctgggccatgatccgtttgatcttcttattggaagccatggccgcagcaaaatcattgctgagccagccaaccatctccatcggccagataatattgttggcgtactccgaaaatgcgcccagttctccgatggtgatccgtttctgaattaccatgatgccgccgactacgatgatcgccatcagcatcaccttggaaagaaaggagacgttaggctgatactttacgatcagctttgcctgctccatatttaaatcgtaataccgcttgttatggcgtttgaaccggtcaatctcgtaatcttctcttgcaaacgccttcacggtccgcacgcccgctaaattctcctgggccacggtattgagctccgccgtctgctcactgatcttgtcgtagacctggccgagaccattctccatctttaagccgtaccaggcgattaccggcataacgagcagcggaatcactgtcagcaccgggcttaagcggaacatgcaggtcatgataatcaccgtgtgaatggtacattcgatgatcagcattccgacaaatcccatggcattccagattcggtccacatcgtccttgacacgcgccatcagctcaccggtgttatggctgtcgaaatatcccatggacagcgtctggatatggtcgaaaagatcctttctcaagctgctcccgatccccgacgccgaataatcaaagatgaattccttcatgtactggaaaatggctcttccaaggccgattcccagaagccccagcagcaggcgcataagcatctccatcttgccgccgacgatgacatcgtcaatgatgtgtctcgtaatctgaggcgacgccgcatccagcagaatgctcactaccatggccgctatggccaccacatacaggatcccgtacttctttacatacttccctaaattcctcatgttgctccccctttgtctatactgtgccatatcaagtcaatcgcagccctgaaacgtgttaaaaactgcccggtctgcgaattaccgcgaaaaacaggaaaaagccgtcaaaaacagcaaattgcggcttttgacggctttccaccataaaaataaccgcagtccagttcagactgcggcatagttaatcaaattcagatagcaaactgacttccatacgaaataatggctgatcagagaccgaattctttcctgaggcagactgactgattattattgtttataattccactgctaattgtacgagatttcatatttctgcctccttttcctttattcggtaatctagatactagaatactgccacttttctgttctgtcaagcactttctgtttttcatgatcagctctcaatattccagtacaacttcgatcctgtctttcccgcggttgtaatagtaaaccttcccagacaaaaagtcgtcatccgacggcatctccctgttgagatcctttaaactctcccgtatcgtctccggatacaccttttcacagttatggatcgctgcctcgtgcatgctggtaaatgcgatgtacaaatcgttccccatcatttctcccagccgcttcgccacgccaggcagaaagatggccaccgctccgttgatctggctcttagtcgtgacgaacgtagcgcaggcgccgccatccatccggacgccgctatcccgttccataaaaataccgtagtcctcatcctcaaaccgttcgacgtccagccagttgaagagacgcggcggaaacagcctgtatgtattctccatggcgtccttcatcacctgttcccggctcctgttccatccgtcaaataccaccttcggcaccatggagctcgtgtaaagtccgctgaaattcccgatgctcacatagagggtcagcgcaatatcgcccgtcatctcgcaaacgccttctttcagcttctccgcattcttctcatagttcagagggcggatgaccagatactcccggatggactcatagtcctccatatgccccagcggactgctcttctcaatctccctgcaacgttccagacagtcggaagcctctgacagcagctcctccatggttttccccagccggaaatcctggtagatctccgccatatggaaccgctggatatggatcccgggaccgtcccctctcaactccaccaccagcaaatcctccggttcttcttcctcaccgtctttttgcagcgtaaccttcgcgccccactcctctgtcatcagaatcagaaacgcctgaaactgctccacaaactccaaatactcttttctttctctctcttttttcatcgtgcattgccttctctttcttaaatttcctgtaatcatgagaatttcatggattaaaggatttgtaagggaatttaaaaatgcccggcatttcgtggaaatacgcgcagccctccaccatcaggaatgcgggaaaacgcgcaaccgtatgattctatcttttattatacgttttaagcgtgaaaattacaatactggaaacagattgccgaaccggcagaacagaatcagaacttcagaatgatattattataaaccggaactccggctctgtcaatgacaaccggctcctgcgcccctatatttttcttgcagttcacagccctgtcagcccctgaactgcagcccgttttcgacaggcttcgtcatatcagacggccggcgcgttccccgcggccggccgtctgtcactgctatctaatctctctcaattctaatctctcccaattacaaagctgaaagtaatgtcgtgttcaccgcttacgcagtattccggataaaccggcgcgccccagctgtcatctccgccgacgccccgcatggccgccaggatcgttacgaccgtataccgcggctgcggcagttcctccacgtgagtggcatgctccagctcctccgccgtataaggaagaaccgatccttcaaaaggacgtccctgcgcggtaaaccgaatgctgtgtcccgctccatccgtcaccttcatccatcggattccggtgcggtttccgcattcctgcggaacgagatagcgcgatacgctgtccgccgccgtatccttaaagattccgaggcgtgcgcctgcgtttctgtcacggtaattctcctccggtccccggccgtaccactcgaaatcaccgccagttccgctgatgcggaatctcatgccgaacagcggcagctccggcagtccttcgcgtccgaagtagtgagccgtggttttaatccggccttctctgtccacctcgtaaacgacctccgtctcagtctcaggaaccgttggcaggcggtaggtataggcgacacgaacgctgtcttccccttcttccaccacgcaggttttgctgtcataaagcggaaagcttccggcgccgtaccaggcggcgctggatacggagaatttattgcctctgtcgttatccgtagtcgctctccagtacacaggcatgggaatcttcccaatccactcccggccatcatagacgagggatacaatgccgccctcctgcttcgagaatattatgtggaagccatttcccttcacgccaatatttacatcaccgtgaataacagtgaacggaaggcggtcgttatcagtgtgatactcttcaacgaagttcttaccaacacaagtctcaccaacacggtccgcatcagctccgcccgcactagcaccgccagtagcagcaccgtcagcaccagcaccgccagcaccaccaccagcaccgccagcaccaatcacccggcagctttccccgaaagccgtctcatacccggcatcagcccacagctccgttttctttttcaccgcggacacctgatacacatactctcccggctctgtaaatgcaggagccggcacgctcacatactcccgctctcccggatttacccgggcacagaatctctccgtatggacgggttcgccattccttaaagcaagccagatgaattctaagtcggaagtgtcggtaaacagtctcctgttttcgatctccacaccgcaggcatccggaatcagcctcagatcctgatagaggaacttcacttcctgcgccttcggcgaaatggttctgtccgcgtagacgattccattgccgcagaaattataatcagtcggccggtcgtcaaagtccccgccgtaggccatatgcaggacgccgtcctcgtcggccttcatcagagcctgatccacataatcccagatgaaaccgccctgatacatgggataccggtcctccagcgaggtgtatttctccatgccgcccagagaattgcccatggcgtgcatatactcacacaggataaacggcttctccggttcctggtttaaatactcctccacctccgcaggctttgcgtacatgcggctctccatatcgctggtctcattaaattcccggttccagaagacgccctcatagtgaaccagtctggacggatccctctccttgaaatacttcgacatggcgaggatatcttcgcccgcgtacgattcatttccacaggaccagatcagtacggacgcgtgattcttatcccgctccagcatggactttgcgcggtccaccacgcattccttccactccggaaggcttcccggcacgttccaggaaggttcgcaggcccccatcttctgccaggagccatggctctccagattcgcctcgtcgatcagatagatcccatactcatcgcagagctcataccatctcgactggttgggatagtggcaggtacggaccgcattgatgttgtggcgcttcatgaaacggatatcccagatcatgtcttcttccgtgacggcgcgtcctctttgcacatcgaactcatgacggttgattccgcggaacacgattcgtttcccgtttaagcacatgaggcggtctttcatctcaaagcggcggaaaccgagtttctggggaacgatctccacgatccctccgttttcgtcgtagagaatgacggtcagcgtatagagataagcatcttccccgctccacagatgaacctccggcaccctgcccgcaaaaaatgtgttctccccggcaggcatgcgttcccagacagcggcggtattcccttcccggtcggtcagcatggccgatacactgcccttcgtgtttccttccagcgttaaatccaccgtgagttctccggtctttaagtcttcctggacacctgggcgtacaaagatgtcccgcacatggcattccggcaccgcgtaaagatacacatcccggaaaataccggagaaccggaagaaatcctgatcctcgatccagctggcgctgcttctcttatagacctccaccgccagacggttgaccccatcctttacgaaatccgtgatttcaaattcggagggcgtaaaggaatcctcggaatagccggcgaagcggccgtttacccatacgtaaaaggcactctccaccccctgaaaggacagaaacagcctcttattcttcagggccgcgtccgtctcaaactccttcacatagcttccaacaggattatcatcccagtccacgtggggaggccgcagctccgagtgaccctcccacggatacatcgtgttaatatactgacattttccatatccctgcagctctatatggccggggaccgtgatttctccaaaatcaccgagacttctctcaggcagataaaaatcctttttccgctgctccggcttcggggcataggaaaatttccacgttccatttagggactgacgcagcttcatgatgccgccgtccgcctcctccctgctctcatagaaccggtggtctgaatgcgcctccagacggtttaccgcaaacacctccggattttcaagccaggctaaatcggcatgatactgatccataagtacatcctcctttttcacgtctattatagggccgtccggcaaaagaatccatctctttttttacgattttctgcactttcttactctttgacagcaccggccgcaattcctgccaggatgtatttctgaaagaacagatagatcacgatcgtcggcagcataatgatgatgattcctgccgccagattctgccatgacccctgctgcgcgttggcataattcatcaggaacgtggtcagcgtccgcagcttgttcttcggcatatagaggtaaggaatgtacatgtcgttgatgatggtgattgccttgatgatcacgaccgtagctgtggccggagccagcagcgggaagataatcctcgtaaacaggccgaaatacgaacagccatccagcagggcgctctcatctaaggatacgggaagcgtggagatgaactggcggtaaatgtaaagctgcatcaggtctgaggccacatagatgacgatcggcgctcccagcgtgttatacagccccaggccgttgatgatcttgaaacgggcgatctccgtgacaaagcttggaatcagcatccccaggaaaaacaggctcatgatcagatttttgaaccggaattgaaaccgttcaagaataaacgctgtaatcgtaccgaacaatacgttgaaaaaaatactgaaaacgagtatgattcccgtatttttaaagccaatcaacaggtatttgtcccccaaaaccttctggaaattatccgtggtcacacggctgaacggaggcagtagtaagggagatgtattgaccatatccgccttcgtcttaaacgcggcaaacagggttaaaaggatcggcgccagcacgatggataccatgcagaggcagatcacctgttttacaatttgctgcagtgtacgctgtttcatcctttcttccctccttttaaaacgactccgtggataatcttattctgaaccacgtaaatgacgacaatcatgatcataatagccaccgccatggtggatgccagaccgaagttgctgtatttgaacgccgtatcgatggtatagagtgtgaaggtcgaagatgcatatcccgggccgccgctggtcataacgtaaggaatatcgaatacctgaagcgcgccgcggatattgtcaaacaggacgaaatccaccatcagcataatggcaggtatctgaatgtatttgaacatctgccatgcgctcgctccgtcgactctggccgcctcctggacatcctggggaagggactggagcgccgccatgaacaggatcacatgatagccggagaatcgccataaggacacgcccgccaggacgaagttcacgatcttcggatcggagagccagtttctgatcagcggttctaagtgaaacagggtgaggatctcatcgaaggctccgttgatcggtgaaaagaagtaggaaaatgcgtaggaaatcgccacgccgttgatgatataaggcataaagaccatggtcttatagaattttgaggcgcggagctttgaggtcagcaggacggcaaacatcagctcaacggggataaagagcagatggccaaagaaatagaccgcgttgtttctaagtgactgccagagatccttgtttttcagcatgtcaaaatagttgccgatgccgatgtaatcgtatgtcttcgaatagccgtcccagttggtgaagctcattcggatcagatcgaaggccggaaccaccacgaagccgataagcagggccatggggattaccagggaactgatgataaatatctttttctgtctttccagtgaattcataactacctcccggattgtattgattttacggaattttgggtataaaaaggatggggcgtctgtacggaaaccccatcccctgttacagagtcttatttaattccaagttttgttcttgcttccgcccattttgtattcaaagtatcgagttctgtctttaaatcaaaaccttccgtaaacatctgagctcccagcttcttgtaatcgaaggcgatctcattctgaattgcctggaaatcatctccgccgccgtcgtacataaccagttccatatctggctgcagcgcgtctgcttctgccaggatcggatctttttccttcgggaaattcgtcatggaggaggcgctggttacgtagcctatgtatcccggataccagtcttcactgtagaaccactccacaaatgcctttgccagctccggattcttgctgtgagtcgtcacgcccatgaaggagtcgccctgtacgatcacgcggaacggatcatcggtggtatttctgaccggaagatagaaggttcccagttcggagtagtcgtccgtaccggtctgaatgttctgtaagccccagtctccaagagccaggatcgccgctttcttctgtgcgaacagcgccgtcacctgatcgttgcccataccaagaggatcttttccaaatacattcatatcaaacagttcattgacctttgtgtaagccttgttgatatccgagccctctgaaaacggtgtgtcggtctttgccatgtcgttccagttctggccgttgccgccctctaatgcaggcataaattccatataagggtaatccggccattcatccttcgctcccagggcgatcgccatgaaatccgggttttcttttccgtagtaatcctgaagtgtctgagccgtctgctcgaattcactccatgtcgtcggcaccgtcactccggcttccttaaacatgtctttccaataaaatacgtattcgtaaccggctgtcataggaacgcccaggatcttgccgtccatggcatagcctgccgccagttcattgttcttcgccgcgtccagatccgataaatcaaccagataatctttgaatctcgataaggtaaatggtttgttgaacattacgtccggaagctggttggcggaagtacgcatcttcatggcgttccagtactcggaatcgtccttgatcttctctacttcgatttccgcatccggatacttctcctggaacttgccgaccatgtcgttctgatcaatgtagtccatcaggttgttgtcccagatagcaaatacaaggcttccctttaaatctgccttggccgcctccgtctcaggagccgccgttgtatccgcctgtccgcctgctgccgttgtcgtgtcggctgccggtgccttttctgtctctttcgaggacgccgtggagcagcctgtcgctgatcccactaccatagccgcgcaaagtcctaatgccgcaatctgtttcttcatgtttcttacctccctagttatgagcacttggcggtcgtcttttgaccgcttacgtgcgatacatgtcatctccactcagcgtgccccgttttatcgggtatagcgaggttctttcgagcttagtggagtggcttagttgatggttccagtttaccattttcttccacgcatctccatgaactaaggtttgaaaacttgatatatcgttaggtctttattttcggtaagcgcccgggctgacctggcagatctttttaaatacccttgtaaaatgttccacactgttgtaccccacgctctggctgatctcataaattttcaaatcggtctgctccatcagctccctggccttccggatccgcacctccgttaagtagttgctgaaggtcattccctcctccttcgtaaatctggaactgaagtatttctcatttaagcccacatacccggccacgcttcccagcgtcagctccgggttggcgtagttatccataataaaacgcttcgcccggctcatcatatccgcctggcggcggtcgttctgatgggccgcgtaatccatcacccaccggaaataattgttgagccacagctccagactccccatctcctcgaggcgtccgatcttctcgtaataattcaccttttccgcaaacagcgcgccgatatcatcatggctctcgttcaggatccaggccagattacagatgagatagagaagctcctgctttgccgaggaaagcccgctccggtagaacgccgcaatgagcttctgcttctcctctgaaaccgccatctcatccgcagtcaacagccccaccgccagacgtttataccgtacgaaggcgtcctttgccgccagataatccacgcttcccctctcccacgggctgcataccgccgcctttcccttcagccagtgaagggaaagccatccgccagcttcctcgaacctggcgaggaaatctcccgccccgtttcccttcgtactgatgcccgcggagactggaaggtttaagaaattattccagacactgcacagctgcctgcatgtggagaccacattgtcctggtactgggcgccatcggagatccggtagagcatcacatagcgggagggcgagatcgtccccagcacgcaccgggaagcgacacgcggaatctgagccgcaaactccagcaggggcctgatcagttctccctcaaagtcgccggcaaatctccctgcatgcttctgaaattcatcgatctcaaactgcaccaccaggtagtctccatcaaaaaatgattcatccagctcacattttcccatggccatggcgctcaggcgctcggagtcggatatcgtttccctgctttcttccgttccgggctgtcttccggcctcgtcttcactctcccattcctcgctcagccctttcagcatatttttcagcagttccccgtttaagtcggccttgagcagataatcgcaggcgccgagccggaaggcatcccgaaccagcttgaagtcatcgtatccgctgagcaccagaaccttcggcataacctcaaaacggctgaccgcctccaatagcccgatcccgtcgagaaccggcatcttcatatcgctgatgattaaatccacggtgtgatcctttaaatatgccagtgccgcctcaccatggatggcgtccgccacaatctgaaagcccatctcctcccagttaatgagagaacgaagggtgattcggatgatggtgtcgtcgtctactattaataccttcctcatatatgcccctccttcgtctccgccggcatacgcagcaccgtctccgtatacttcccgacctcactccggatcttcagcgcgcattcatctccgtagtttaaaacgaggcgcgtgttgacattggtcactccgatgctcacataatcttcatttcccgcagtttcattcgacaggagccggcggatctcctcctccgtcattccctttccgttgtcacggaccgttacgtacagatatgtgtcctcaagacgggccttcaccgtaatcagccccagctcctcttccagtccggagaagccgtgaacgatggaattctccacaatcggctggagaatcagcctcggaaccatgcacgcaccgcaattctccccgatctcgtattcgatctcgaagccgtcggagtaccggatcttcatgaggtagataaagccgtccagcacctccagttcctcgtttaaggtatagaaaccgacattgctccggaacgagcaggacagaatcttaattaatgcctccgccatcctggcgatcgcctcatatctggagacctgcgcgataaagcggatagaatttaacgaatttaccagaaaatgagggttgatctgcgactgcagcgcccggatctccgcctcgtgcttcttctgctgttcctcctcattctcctgaatcagctgcttcagccgcctcgtcatgcggttgaaggaatggatcatgacacgcagctcagcctgtcctacaggcaccacatggacatccagcctgccctcttccaccagcctcattccttccaccgtgttgtggatggggtcgatgatattctttaaaaagtagctggaaaatatatagaacagtccaaacagaacgaccgttaccgccacgatcgccgcggcagtccggttgaaatcccgtgtcagcagttcggaatcgaccacactgacagcgaggagtcccgtcaccggctcctcagaaatgacgtaaacgtaattttttccgtccagcttatggtgcagttccgtctctcctcctgaaacaatctccggaataaagaagcgcatgccgtcggccacatcaaagaccggcgtcccgtcgggatttaagagcatggtaattcccagcagcttctctttgttgtactccttaattaagttccctgtctgggaggagacgaacagggcagtcatctccaccacattatcgcggtccacatcgatcccgggggaaagcccggccacaatggtcagcgtatgggcctttctggaggtcgccacgttcctgtcgtagaagccaacctttaccatgttcttatcgttcaaggcctgctgataccagtctgacgctttgatctcctcatccggaagaatgatatcatccttcatataggtagatcccccatccttcatataaaagatggcggacagaatatcctgcaccggaaccatggcaaaattaaaagattccgacagcataagcgtcgcgctgtaccgcttcgcaaagtcctgcgtatcggtcatcgccgctattttcatgatttcgttgtcattgacatagacaaaatgggacagccgcagggagacgtccttcacctcgccgcccagtgtggcaatgatattgtcctgggcgcgcttaatgctgcgggtcgcggaatcgaccatcatcgtgcggatgatggcgctggaaatgatgatgataagcagaatggggatgacaatgagggcgagaaacgtgtgataataagaagcctttaaattcttctttttattcagccacatcatgtcccgccctccggttctgccattttttgtaaatagtatttcatattatacaatactgaaattataaaatcaataaaatggttcgtatttatacgccttcttccgtatcatgttatactcgattacctccgtgtcaacgtaggtatgagaatagacaaacggcgtatccgtcttatcgtaattaatgcccttcagaagaagaaacgggtgacactcctctccgcttaaaccggccggcccgttgatctccggaaactgccggttggtcaccgtctggattctcatggtatcccacatcgccttccttcccttgtaccggtaaagataatcgaatatggacagctccgggttaaagaagctctgcatctgctccctggtaagctgctccttcgggaaatgatcgatacagtacatggaaaacctgtcccccgcaaaaaatgtcttctttacggcgaccatagtctcccccaatgacacgccaagtgatgagacggcttcttccccggccgcctccgtgatgacgccttccacccgcacatcgggcgtccttccgcccttgcgtatgatgttctcatacagctcgggaacggccaggttaaaggcgatccttcttgccatgggattgacatacgttccgctcccatgcctggaaaatatacgcccttccatctccagctccttaagcgccgaccggatggtgacccggctcaccccgaacatggtgcttaacttttcttcagaaggaagcctgtttcccttttccaggtccatagactggatgtactccatcaacttcttttttacctgctgctttaaactgctctcctgccccactgtgcgcctccgctcttctcctgccgctattcggagtatagtataccataaactgaaaattcaggaaagacttcctaacatgtttcaccatttccgcctgtatttttatgcattccgaaaagtggtaataccattttttccgaagtggtaataccacttttctctttctacagtttttgcctccttccccttctattttttgttatattgtacagaaaataatgttattctctttgttttattgacttttttgtgcattcgttctatcctgaaagtaaatcaacagaaatttcgcaaattttctgattttttacacgttacttcactcttttacagtatcagaaaggataaaatcatgaatcaactaaacgaagctttagattccttttttcatttaaaagaacgtggaaccacggtccggacggaactggtggccggagcgacctccttcatgacactcgctttcttaattgcagtccatccctccatcatggccagctgcggaatggacaaaggggccatggccacggttaccatcgtcagcgccatgatattcaccctgatctgcggcttatactgcaacatccccttcgtcctcgccacagccatgggcagcaacgcgctgatcgcctactccatcgtcggagccggcatcacgacctggcaggtcgcgctgggaatgaattttatctccggtgtcatcttcgtcatcatcagtgtatgcaatatccgtgaaatggtggtaaaggtcataccgaagggacttaagatcaccatgggcgcggcggtcggtatgtttatcacggcgaccggcatgtccaacgtcaagctgatccgcatcaatgattccggctttttaaagctgggagatttacacagcccggaaatcattctggccggaatcaccctgctgctcatcctggccttcacctccagaaagatgaaatccggtctcctgctggccatggtcatcggaaccgtaatcggcatccccatggggcttaccaccgttcccagccatttgatcagtatgccgccttccatggctccggttgcatttaagctggatatcccgggagcgttaaaactcgtctatgtgccgtttattctcgccttcttcatgggagactttttctccactgtaggcaatctgttcggtatcggctccaaggccaacctactggatgaggagggcaacttcccggatatcaagaagccctttatcgttgacgccgtaggcacctgtgtcggcaccgtcatgggaaccaacacggtcactatatacgcccagtccgccgccggagtagaagccggaggaagaaccggactcaccgccgtaggctgcgccatctgtctgggactggccctgttctttaccccggtcgccctgatggttcccaacagcgtatcctcggccgctctgatcaccatcggcttaggcatgctcacctgtatggagaagctggactattctgatttcacggagtatatgccggccttcgcctccgtgatgggaaccgcctatacctacaatattgccacgggactgaccctgggcatcatcacctgtgtcatcaccaaactcgctgccggtaaggcaaaggagctgcatcctgccatctatatcattgcggttcccctgctctactatctgatagcgctcgcataaggaggcgttccatgggagtcactctgtttaaaaactgcaaacttctctttggcggagccgatccggagtctgtctccaccggcctttccgtcgcggtagaggatgacaggattctgtttctgggaactgaaaaagagtattacgaacagcatccggagaaaagcttgcccaccgtcattgactgtacggataagcttgtcatgccggggctggtggatggccacaatcatctgtgcaacacgctcatgaatatttccagggcgtttccctttgattacagccacatctcggatcacatgctcaccaccatacacgatccctatgggtggctgacgccggaaagcctgtacgacatcaccatgacttcggccatcaacgcattaaaacacggaactacgactgtggagaacagcaccatcctgccggacaccgcctatgaggccatggataccagcggcatacgcggcattctggctcctcagatggcttcctccttccgtctggattcagatccccaaaactggaagcaggcgctggaaaagacgaagtcctgcattgaacattaccacaatccaaaacgccgcatgtcggtggccgtacatattcatgacctgtgggactgtatggaaaagctgatggacggcgcgctggagctggcggagcagtatgacacccggttcgtcacccatttctgggaatttcagaacgccgtggaacgggctgacgagatgtggagggacgacggcggcgccttctcccactacatgaaaaagggactgatcacctcccgcagcgtgctcttccacggctccatgctccgggaaccagagatcgaggccatcgccgggaccggcgcttccatcatacataatcccgatatcaacggcaccaactgcggaaactgcgcctacgttccctacatgctgaaaaacgggatcaatgtcggactcggaagcgattacggctctctggacgccatgtcggccatgaagctgatgctcatcgtgcacaacatcatgccgcgggctgaacgggttctcccctatcaggctccattttacgcagccaccatgggaagcgcccgcgcatacggtctcgatcaggagatcggttccatcgagccgggcaagaaggcggatatcattaccattgatttaacgaaagcgcctcatctgctgcccctgtgcaccagccttctggaggtcagtccggaacttctctacttcctcttcacccggaactgcgccggaacgaccaccagcgagaccatggtggacgggaagctccttcgccgggatggggaattcctaaacctggatgaggaaaaattcgtcaagaagacctttgactggacggaacggtgcatgaccgatctaatggaaaagcaccgattcggagaacattacgcccgaatcatccatccggattttatgaaggatggggatatcacctgggacgtgctgaattaaattctgacttatccacaaaaatatgaccgcagcatcagcggattcctatcgctgatactgcggccgctattattcttctttcacaaaagtttccaccctcgtctccagccgcaccttctcccccttgcggatcttataggctaccgcagggatagacgcgttggcgtaaagcacattcgtattgggatcggctccgatcacgacgccggccgcctccgggccttcgccggatacggtacagccctgtttcctccaggctgcggcggccgtctttccttctgccgactctccgtacccttctgtaaatttctccacggcaaaaccacagtcataggccgtacagtcataggcgctctccacctcatggatccgcatgtggccatactccgtcggcaccacgaccgaagtcacccggattcccgggaacggctgccagtcgctgactacccggtccgcaaagatatggtacgattcacttaccttcctgacaaacacgtaatcatcgccgtcaatcacgaaggccagagcagaatccggcgcattctcatggagcacgatctggctgcgcgccacggaaaaaccgaatttcgtggaatacgcgaacttggagtatttctccggcacatggccgtggccgtatttctcgcagactccggccgggtaggcgattacatctcttccgcgccggtgtacgatcatattggcctggagcatcattttcacctctggcagagccggaagcggtgcggcctccgtgctccagaacgggtggtcatccggaagcgccagacacagaagcgtcttcattccccagtacggcgaccccggcgcattgtagcgctccgccatgattaaattcggatacgcgtaaccgatggtcagcacgccgtcccggtcaaagatcttctgttcgcaccaccagttcaaatggcgggcgagaattccctttactacagccacgggaatgtcatcgaggccggcaaacacataggccgcccagaacgccgcctcaccaaatcggtaggataagctccttccatagggaagcgccgccccatccgcatcgaaccagcagatgaaatccccggcgaagattctggcccgttcccggaagcgggtgcaccgttccgggtcctcatccgccatggccacggaatacaaaagcccgtagtaatgcatggcaaatgagatatagtaatccttctgccccgacgcgccgtcccggtaccagccgtcttccagatagtagctttcgatcttatccaggccggacttcagattatccgcgtcgtagcggcagccgtttttcttaagagccacattgaccagaatcataaaaaactgccagttgcagtccggtatgatgtgctcgttaatcgcgtaaagccagtccgccagatgcttctgcccttttgccccgaggggctcccagaccttctccggagtaaagatcatcccgcttgcaatggccgccatctccacgaaccgctggtcataatccgtaaagccgccccagtattccggatgcgccgggtctgttccgttcctaagccccttctgatagatttcctcaaaggagccgtttactccgccgcccttccagaagggaaccagggcccacagcggccgggaaaatgcctccatctcgatgctgacctccggataggtcacgccgctgtctcccagatgcagacgggcgccgcccgcgctgtataatggttttaggggattcaggacggagaacatccaatccctgaaatcctgtttcgtctctaatctcatgttcttttttttcctcctctaccagtatgggttccagtctttcgagagtctcgtcagcgcttccatatagaagtaatcgccccagatgttgcactcgtcaacgccctccggcgtacacgtgttatacggagatttcttggagtaggtgctgtgaagaaccaggccgttcgactccgccccgctctttaccgcgtaattttccaccacggacttcatgattttctttgctatggaggtgtagtattttgcatcctcttcgtttaaatatttcgccatttccagcattccgcaggcggcgatggaggcagaggaggaatcccgcggctccccggaaccgtctccgaattccagatcccagtacggtacgagatcttccggcagatggtccaggaaatatcctgtcacatgcttaaaatcgctgatatacgcttcccgcttcgtataccggtaagccatcgccgtgccgtagacgccccacgcctggcctctggcccatgcggagccatcccggtatccctggcaggtcgccccgtgatccggctctcccgtctccatattcatgaaaaaggtgtgccacgtggagtaatcctcccgaatgacattggcgatcgccgtatggatatgcttctccgcaatatcccggtatttagcgtccccggtctcctccgacgcccaatagagcaggggcagattcagcagacagtcgatgataaaccggtagttctccggctgatccatcggcccccacgcctggataaattccccgatcggatggtatctggtgatcagctggtccgccgccatgacagccgcccgttttccctgcctgcttccggtcagcttgtatccggcgacgcaggaagggctgtagagaaagcccatgtcgtgatggtccacgtccgccttcgtctcgattctcttataaaagctgtcgatctgaatcgctcctgcttccttcagagcctcgtccctgctccattcataggccagccatatctggccggtccagaagcccgtcgtccagttgacattgggtgtcggccggtagaagccctcctcgctgtacgccttcttgaaggaatgcgtaaattcctttaaattctccttcacctgtccggcggcaaaatccatagcctgacggcacgcctccccggacagctcattcttttcattcagacgtctgatcgtatccgcattcatgttttaaaacctcctcgtaatagttctgcatcagataaaacgccggtttcttccggctcctgtcctctgtgatcagtcccttgatgttatatcccttctggtactttcccagccgcttcggcgtgcggaaatcaaacaggatccagggcgttgtcccctgaatatacggaatcctccggaacacggcaatctggttttcgtagatctcctcctgttccttcacagatcctctgacagggcttttgacttccctctcctctgcctcaaacgccccatccgcgccgaattcgctgatgatgaccggcttttccggcgcagactgttccagtatggtgctcagtttggtgtagtccggatcgtaccagccgtaatattcattgagtccgatcacatccagatgcgcctccagccggtccgcaatccgcagattcacggtatccaccagacaggccgcggagatcagcctggacggatcggaacgcctggcatactccgctaagtccgccatgaagcggtaccgctcatccgtatccggattctcattaccaacggaccagatgatgacgctggccctgtttgcatcccgtttcatcatctcactcagctggcttttcgcctgtccaaaggtatccggattcccaaagtcaatccaccagtacacggggatctcctcccacagaagaaggccctcctcgtcggccatccgcgccgcccattccgtatggggataatgggccagacggacgaaattgcagttcatctccctggccaggcggaaggcttcccgtatctcctccttcgttaccgcctttccatggtccctggagtcctcatggaggcagacacctcgcaggaacaggggcctgccgttcaagcgtatggaacggcccgccgtctcaatggtacggaaaccgacacggtccgagatccggtcggaagcccggttctccccgtcatataaagtcagccgggcattatagagcctgggattttcaggactccacagctccagctccggaaccttcagcttcagccggcccgttccgtcggggccgaaatccatgatttcacagactccgatctccggtatctcaaaaaatgcattgtaatcgggcgaaatactgccggctgccaccgcttccactgtaatttcccgctctcttcttccgctcagtctcaccttcatgtcctgaataaagacctctggaagacgaacgagtgttacactcctgtagattcctccatacggaaaccagtccgtgttgagtgaaggcacatccgcctgatgcctggtcccatccgccacgacgatcagccggttatccgctccctccttcagactctctgtcgcctccacgcagaaaggcgtggaaccgcctctgtgaacgccgagaaaacagccgtttaggaacaccctcgcctcaccggccaccgctccgaaccggatgaacacccgctcatttccccggcttccataagaaaaccggcggctgtaaaccgccggtccctcatagtagaaatactccggttttgtgagattaaagacaccgggaaccggtacggtctcccagtcgtcgaaagcatagtcaaggggtaccgcgcacccttctgcattcgtcccctcctccagaaaccatttggcccggaggcagttatcgtataggtctacggagaaattccagagcccatccagactctcttcctctctccctccctgcataatcaggctttccgccccgattaagggagcggaataagcgtttttgtatgcctcgttgtgaatattgtccacgaaatttttaatctcttccattgaaaccagtcctttcccgatcagccctttacgccagtcgccgcgatgccttccacaaaatactgctgcagtgtcaggaacacgatcagaaccggaattaaagacagtacggaggccgccatgatcaggccgtattcagagctgtactggcttaagaacatttttaatcccagctgaagggtcttcttggcttccgtttttaagtagatgagcggccctaagaagtcattccaggtgttgacgaaggtgaagatcgtcagtgtggagagcgcgggcttggagagcggaagcatgatcttagcccagatctgatattcgttcataccgtcgatcctggccgcctcacagagctcatccggaattccctggtagaactgtctcatcatgaacacgccgaaggcagagaatgcctggaggcagatgatcgccagatgcgtatcgttgagtccgaagcttctcatcatcatgaactgcggaaccatgtatacctgccatggaacggcgatggttgcgatataagccaggaacagcccattcttatgcttgaaattcagttttgcaaatgcatacgctgcgaagctgctggtgagcagctgtaaacatgtgacgattaaagtgatcttgaccgtatttacgacgaatttcataagaggaatcttcgtccagatatctatgtagtttttccatctcggattctccggtatccactgaatcgggaagataaatacatccttatccagctttaaggaggctgacaccatccatgcaaacggtaccagcataaggaatgcaaagacgatcaggactgcatagaggataacccggctgatcttataatttgtgctttgtactttcatttttcttcctgccctccttaattcgcatacttcttctcaccacggaactggatcagcgtgatgacaaggaccatcaggaacaataccatggcgaccgcgctggcatatcccagattccagttacggaacgcttcctcgtaaatatggtagacgagaaccatggctgaggagctgacaacgccgttggaaccgcctgccagcatgtatacgatatcgtaaaccttgaaacagttaatcgttaaaataatcgtgacaaagaacgtcgtcggctgcagctgcggccatgtgatgtagcggaaacgctgaagggaattggccccgtctaagctggccgcctcatagagctcggcgttgattccctgtaaaccagctaaatagatgaccatgtaatagcccatgttcttccatacggaaaacagtacgatggtgaacatgacccagtgggggtcagccgcccatttcggcaggctcttcgcagatacgcccaactgatataaaatcatgttgatgggaccgctcttctggggactgaaaagcatgttccatacagcggccacggccaccagcgacgctacataggggaagaagctgacagtacggaagaaattccgtcccttgaccttctgatttaacaggaccgccagccccagcgcacaggccagggtaaacggcaccgtcgcgagacagtagacgatcgtattgataaaggacgaccggaatctggcgtttcctgccatctgtataaaattctttagtcctgcgaactccatggggctgttgccatcccatttcataaatgccagcacaaaggcaaagataatcggtcccaaagtaaataccgcgaatccgatgaagttgggagcaataaaggaatatgccaccatgtctctcttttcctgtctggtaaaacgctctcccgtgcgcaccttcttaatcttctcttctgtcgtctcgatctgggagatcagtttgtttctcttatgtgactgttctgtatttttaagctcgcgctccagagcctcacgccttgtgagcagcgcagcaattttttcgtttttctgtgcttctgtcattgtcttagccaccggcttttcctcctttttaccatttaccattccacaattcgtttcaaattcagaggggattctttaaatgaggcgggcttttattctgcccgcctcttgatgctgcctgattgtcgtctgcgctttttattcagccaggatagcgcttacctgctcatccatctgtgcgattccgtcatcgacagacatgcttcctgtcatgatggcatcatgtgcttcgttcagtgcggtctcaatctcagagctcttcggatgtaccggcatttccagatacagatttgcagtatttaacgcgtctacactggtttcgtcgtccttcgggaagccttccgttgcagataccaggttcgccacttcgtctgtcataacagccgggattgttcctgttgctgcgagaacctctgcgccttctgctccgcttacgaagtttacgaactcccaggccagatctttatgaggtgcgttggtcgggattgcgagggaggtgatggttgccagtgtggaaccagcctctacgccgtcagcatgaggatactttgcaattccccagtttgtgcagtctgtgtactcgcctgttttgatcttctcgatcagtgtggagatgaaccaggttcccatgttcatcatcgctacgttgccctgggcaaatgcgccggagtaatgaaggccgctggtctttaaggttgcataatcctggcatacgccgtcttcctgctctgcaagaaccatgtcgtagtatggctttaagaactcatactttccgtccagaatcgtattctttccatccaggataccgaacagctgaactgcggatctccatgtgtggtagtgagcgccgtatacttcctggcctggggtgtcgacagttacggatctggccagcttatcatactcatcgaatgtcatgtcgttggtcggataggcaactcctgctttgtcaaatacatccttgttgtagaacagcacccagaagtcatttctgaatggaagctcgtataacttgccgtctaccgtaatctgatcggtaagtcccttgtactgagccagatccacgccggaatctgatatgtagctgtcgagaggctccagcacgcccttgttcaccaaagtcatgtagcctggaacgtcctttacggtaactacgtcgaagtcggaaccattgcctgtaagctctgtagcaagtacagtctggtaatcggtggatcccaaatctaccatttcaatagtgacatccgggtgagccttctcgaactcatcgatgagcggctgataataggtcgtggagctgatatcccagacagaccacttaagagttgtcttatctccagaggccgctgccgtcgtgtccgccggtgcctctgccttcgttgtcgtctccgtggttgttccttccggtgcagccgttgtttccttgctgctgcttccgcagcctgccagtgtggtaactaccatcgctcctgcaagtgcgagacttaatgctctttttttcattgtattccctcctgatttgaatttggtaaatctcatctgtttgtgatttactatgcctaaattataaccggaccgccggctgaaaagaatggattttatctcataaaatattcattatttattcacaattatttcataaaccccttggcaatgtaattttttacgattaataatacaatttctctattgtatacatattgcattgtttttcgtaaagtaccattctattttttattcaattcgccttatgggcgaattggtgcgagcgcccgccatgtccgcatggcatggtgcctttgggcgctctgcacatccgccggaggcttcaacagccgttattcgggtgttgacaatttacaataaatagtctaattttgtatatagaaatctgtagagagaggaatccatccttatgataaagaaatttcttcccagttccatccgcggaaaaatcatggccgtaacggcggcgatcacggttctgatcgcagtcatcaccatggcggtctgctactccgtattccagtcttttcttatgaaaaaccagattcagtccacggaattcaacctttccgtcgtcagcagcaacatggcggaggatatgaaggagatcgttaccttcaccaaatggtgctgctcaaacagcgaggtcggccactatctggaacggctgaaggaccagccgaagctcccaacggcttccagggacaccgaggccctgcgcccgctggctctgaccgcttacaagcggctgaatgaggaatacataacctccgggaccgctggcggcaagaagtatatggcccgtgtcatcatctccactcccaataccgggaatttcctgcagtccatgaccagcgccaactactccagctccttcgacgccgcgcgggtcagcaaaagcagcttcttcgctcctctgtttgaaagccccgattttcgctggatcggggtggtggacgatccgatctccaatgccaatcacgagaagatcatccccatcgtgcgccccgtgtatgacgaatacagcctggagatcatcggctggacctatgtggaggtctcctcccgcctgttcacggactacctggcttcctatcctcaggccagcgacagccagctgtttttaaccatcggggacaagacctacggttcctccagcagcacctggtccgatcccgccatgccctataccgattttaagcctgtgaccggcactgcaacactggatcccggcacgcaggtattttccgtggtctcccccaatggggaaaaacggatgctggtccggcgtcctgtcgaggtggagggagccgacggctggtatctctcccaggttttatcccggcagcagtttaaccagcagcgcatggtctacctgctgctgattgtcggaatcagctcagccatcatctccctcggctgtctgctgaccattctcttgaacaagatcatcagccagcccatcaaacggctcagtttaaagattgacgccatcgcagacggagatttctccagggacagtgaaatcgaatggaaccacgaactgggctccatcggccgcggcatcaacaatatgtcggaaaatatcgtaaccctgatggacaagcgggtggcggacgaaaagcagaaaaaagatctggaataccagattctgcaaagccagatcaatccgcatttcctctacaatacgctgaattccatcaaatggatggccacgatccagaacgccaccggcatcgccgacatgacgacggctctcgccaggctgttaaaaagcgtctccaagggaacctcgtccatggtcaccctgcgggaagagctggatctcgtcaaggattacttccttattcagcagtaccggtacggcggaagcatcaccatggactaccacatcgaatcggaggacctttacggctgcgagatccaccgtttcaccctgcagccaatcatcgagaatgcgctgttccacgggatcgagccgaagggaaccgccggtgccatcacggtatccgcagaatccggcacggtgaacggaaagaaagtgctgaagatcagcgtaaccgacaacggaatcggtatgacccgggagaccatcgattccgtgcttcacgaggaagacaaccccggcaaaaacaagaccgatttcttccgccacgtgggaatcagcaacgtaaaccggagaatccagtacgatttcggactggaatacggaatcaccattgtcagcgaaccgggcgtgtacacgaccatgacgatcgtacgcccttatatcaaccaatctgaaaggaagaaagatgaggatctgctatgataaaattactgattgtagatgatgagccgctggttcagatcggaatcaagtccatgataaactgggaggaatacggaatcgaggtctgcggcaccgccatgaacggcgccaatgcgctggatttaattgaggaatattctccggagatcgtcatcaccgacatccgcatgcccatcatgaacgggctggagcttgcaaagacctgccgtgaaaaatacggaagaattcctctcttcatctttctgaccagctacgaggaatttcagctgatcaaggaggccatgacctacgaggccgtcgattacttaatcaagctggaactgagtgctgactccctggcagacgccgtgaagaaggcgaaaaaccgtctggaaaaccttcaggccgtcgtaaaggccaaagaccccggccgtcccctgctccagagctactatgataaattcatcctgcgcctgctgcacaatctcttcgacacggaagaacagttccatctccaggcgaaggatttgaagctgaccttcacggacgcctgctactgcgccgccctgtttgagatacgcgaggaatcccacggctccatggaccatgccaagctgatgaatctctgcagcagcacctattccatggcccgggatattttgaacaagcacgttccctgttatgccatctctctcgacatgaagcactttgcagtgattttccacgttcagaagccggagaacctaagcggcgcccagcttcagagcgcagtcaaaaatgcggtggaaatggttcacaactactttaacgtcaccgtgctggccgggatcggcagtccggtggaacagcccttaaagatctgcgaatcctaccaggacgccagacaggcctttggccggaccaaaagcacagccccgatcatccagttttcccaggatgacacccagtccgtcaagaacgcgttcaacatcgccgtatttaaaaatgacatcaccaaggctttcgacgaattcgacaccgacgtcctctaccggacgctttccgagatcatcgagctgttcagagcgcatcccctccgcttcctgcaggcggtggacggggcctgcaatatcctctacttagcgctctcccttctccccgacggagaggaaaacatgatggagatcttttcctcctacagcgacggctaccgttccatctaccgttttaccagtgtggatcagatcatcgaatggatgatcatcctgcgggacggcttatgcgaggtgctaaaatccaagagaaagacgtataaagcccacgtcatcaccaacgtgcagaagtacataggcagccacgtgagcgagcgcctctccttaaatgaggtagccggcgtcttcggtctcagccccaactatctgagcattttatttaagaaaaactgtcaggtcggcttctccgagtatatctcccaggccaagatcgcaaaggccaaaagcatgctcttagagcaggacatgaagatctacgaggtggcggacaggctgggctttgaaagcgccttttatttcagcaaggtatttaaaaaagtggagggcatctctccgcgtgaatatatacagcaaaacaccatcggacccgatggagaacaaggagacacattatgattacagaagcagcaaaaactctcactgattcactcagacttttcacgccctgcccgccggcggccgacagggaatgctgggagaagctcccggaagacttgaaagcccgcctgataagaaatggagaagcctatctccactacgaatatcccgccttaaccgccgtggatttcatggaatttacacgcagcggaaacagaagccgctaccaggacaggctcttcgccagacggaccgctttagacagcctggttctcgcggaatgtgcagaacaccgcggccgtttcctcgacgacattatcaacggactttacctgatctgtgaggaaaatgcatggcagcttcctgctcacaactcctatatccgtgatacgccccagtttccccttcctgacgtcacaaggcccgtcatcgacttattcgccgccgagaccgcttccgtccttgccgtggcggaatatctgctgcgcagcgaattaaaagaggtaagccccttcctctccgtcatgatcgaccacgaactggagacacggatcttcacgccctatctgagcgaacatttctggtggatgggggatggaaagagccatatgaacaactggacggtctggtgcacccagaacgtgctgctctccgcctttacccggcctcttccgaaagagacacagaccgcgattctaaccaaagcggccggaagcatcgactatttcctggctgagtacggcgaggacggctgctgcgatgagggcgcccagtattaccgccacgcagggctctgcctcttcggctgccttgaaatcctgaacggaatcacggatcatgccttctccttcgcctgggagcaggaaaagatcagaaatattgcctcctacatcttaaatgtgcacgtggatacggtctattacgtcaatttcgcagactgctcccccgtggccggccgctgcaatgccagggaatacctgtttggaaagcgcaccggaaaccaggcactcatggagttcgcggcctccgattaccagaacagcgaagacccgctcaccctggacgagcacaatcttttttaccggcttcagactgtattttcccatgaggagatgatgcagtacgacaggaatcccgtgatcgtccaccgggacctctattatgaaagcgtcggcctcttcatggcccgcgacagccgcctctatctcgccgtgaagggcggagacaacgacgacagccataaccacaacgacgtcggcagcttcaccatttacaaggacggaaagccgctcttcatcgatgccggtgtggaaacgtacacgaagaagaccttctctcccgaccgttacgatatctggaccatgcagtcccggtatcacaacctgcccaccttcgtggaccacggcagagagacggtccagcaggccggcgagcagtactgcgccgcggatgtacggtatgaactgggagagacagcctgccggatctccatggatatccggcaggcgtatcccgacgaccggatccgttcctacacacgggatgccgtgctggaaaaggaaaaatccatcaccatcagagaccactacgagggtgacggcggtacggccgtcctgtcgctcatgttctgcgagaagcctgtcattgatcagaataccatccgaatcggtgatctggccgcctgtgcagtggaaggcgcttcctccatcaccgtggaagagattccagtcactgacgagcgcctgaaaacggcctggaagcacaatctgtaccgctgcctcgtcaccatggaggcccacgatctgactctgacgattgtttagagccttgcaccgataacgcagtcacagcactgcactgcataaggaggctaactcttgaaccttacacgaaaggccatcggaggccgtattctggccgccgcaaaaaaagatacaattctgacggtttccctggtctgtgccgttttttccatgtttctcgtcccgccctctgccgcctacatcggatacgtggacttccgggtcctggcccttttattctgtctgatggtggtggtggccggatttcaggaatgcggcctcttcgtcctgatggcgaggaagctgctttccggcgagaataatttccggcagctctcctggatgctggttatgctgcccttcttctgttccatgctgatcaccaatgacgtggctctcctgaccttcgtcccctttacgatcctcattctggatatgatcggcgaaaagaagtatatggcctggatcgtggtgctccagactgtggcggcaaacttggggagcatggccaccccggtgggaaacccgcagaacctcttcctgtacggtcgattttccataccggcaggcagcttcttcgcggtcctgctgcccttaaccgctctgagcttcctgctcctcaccgcggcagtgttttgcattccccggatccccatgcagatccggtttgatgctccggcggcggccccggaaaaaaacgttcatccggcgctctttttgtttttgttccttctctgcctcctgtccgtattccgggttctggattaccggatcgtgctggccgtcaccgtcgtctgtctcctgctcttcgacagaaagctgtttcgcaccgcggattaccttttgctcctcaccttcgtctgcttcttcctgttcgcaggcaacatggggcggctcgactggttaaagcgctttatggcagagattctgaaccgtaatccggtgcttttctccgctctgacgagccagtttatcagcaatgttccggcggcggtgctcctctccggttttactaacgactggaaaccgctcctgctcgggacgaacctgggaggtctgggaacgcccattgcctcgctggccagcctgatttctctgaaattctacataaaagaactgccagataaggtttcccattatctggcagtgttcaccgcagtcaatatagcgttttttatcattctgtacgcggcggccagcttcctttagaagcggccgcccgcagttctacataagcggtgcaaacagccgcagcacgcgccccgcaaacttcttataccacggatagtgccggcactcctccagagtgattacctggctcttggccagcgtctccttaaagtccctctccacatccttaatcacctcgttgcggtaaatataggccgcacactcaaagtgcagatacaggcttctgtaatccatattgatcgtgccgaccaccgccttctcgtcatcgctggtaaagaccttggcatggacaaagcccggcgtgtactcgtaaatctgcacacccgcacggatcagctcctcataatgcgccttggccagcaggaaagcgtactccttgtccggaatatggggcataatgatgatcgtctcaacaccgcgcttggccgcaaactgcagggcctgtaccagttcgtagttgagaatcagatacggcgtcataatatgtacgtagtttctggctgtattgatgatatcgagatacaccagctctcccacggtctcctgatccaggggactgtcgccgtacgggatcacaaagccctccatggacagctccggcggatagaaaaattccggatccctcagataccggccgtaatcctccggctccttctccgtaatattccacatctggagaaacatcatcgtaaagctggtgaccgcgtcgcccttcaccatgatgccggtatccttccagtggccgaaacgcaccttcctgttgatatactcatccgccaggttaatgccgcccgtaaatgccgtgtgcccgtcgatcaccagaatctttctgtggtcccggttattctggtaggtggacagggccggtctgatcggcgcgaacatcttggcctttaagcccttggccctcaattccctggggtagctgtacgggaggaggacgaggcagcacatgccgtcatacataaaccggacttccacgccttcctgcaccttgcgctccagaatctctaagaggctgtcccacatctccccgcgttccacgataaaatattccatgaaaatgaagcgtttcgccttctccagctccttcttcatgtcctcgaacatctcttcgcctaccggataatacttcacattggtgttgccgtagaccggatagctgccggagttctcgatataggcggccagattcgcgttgctcctgcttgttcttgccagctgctccatataacggggattctgtttcagatacggctgcgtatctgagatattctcccgcagcttcctgttgatgatcttcccttcccactgcagctccagaaagagatagagcagcgtgccgaacacgggaatcaccgtaatcggaatgatccacgccagcttaaagcttggattctcatccttatttacgacatagaggatcacaaatgcactgagcagcgtaaatcctccgtaaatatagaccatgtaatgactcaggaagcggaaacctgcaagcagtatcgatatctgcagcagcagtgacatcaccacaaacgcagttcgcccgaatatgatcctcaaaagttttctagccttcttcatcctttgtctcctctcctgtataaatcattacacattatacaccatgtgactctaatgtgcaacaatcccagagagaagaccgcctgccagcccccttgaaatctacacgcatagattgctcagcattccgtcataatccggataatttcccgatccgtctctttcataccgtctttgcccagacggccgatattccggatcgtgttttccaccccctttgagacaattccatccccgccgtaaaactgctggccgtttaaatacatggaatatcccaggataccggcatccacagaggccgcgatcttcgcagcgcaggatggcttcgccccgtcacatacaattcctgaaacaatagccaggctgttgaccagcgtatgtgcgatcgccttaaaatccgcgcctttcagccatgcgatgccgcatcctgccccgctgccggcactgacggcaccacagtatgcggacagacggcccaaccccgttttcagatggatggcaatcagattggaaagtaccagtgcccggtagagccgctctttgctgcacttcagctccttcgcgtattcgattacaggcagcgaggcagccagcccctgattcccacttcccgagttaatgacgaccggcagctcacagccgctcatcctggcatcagaagccgccgcagccgcagccctggctctcacctcaactctatcgccgtatgcttttaagatggtccttccaatgttggctccgtagctgttcctgagcccttcctttgatattgccgtattatattcaatctggcaatccaggatttcactgatttcctccgtatccaccgaattggaaaactcacagatggactccacattcaaaagggtccggtcagagtccggtcttcttgcggctttctgttcagccatttccaacaggacttctccattccgttccatcagcacaatctttgtatggcagccggtaattcttaccctggcctgattagatccgcagtatacggtcaccgccatatccagcacctcctctgtctccagaggccgcacctcgatatggttctcttccaaataggctttgatctccagcttctgccgtgcggtcacatcagagagtacctccagttcccgctcttcattccccgccacgatccctgccgcagcagctgcctcaatccctttcaagccgcccgtattgggaacaacgacgctttttacatttttaatgatatttccgctggcctctaccacacatcggtccggaatggctccaagaactgctctcgccttcgcgcagcagtatgccagagcaatcggctccgtacagcccatagccggcaccagctcctcccgcaaaatcttcatatatgcctgatatctgatatcgtcttttgtcatctccaggttcctcgcatttcatctctttattatttttgaatctccccatgtactgtttcccatctgtcattcagaccgtactttacctatccggccgcatatccgatttcctgctttacaagaagaaaacgacagagtatgataattatattgttacttaaaacaggagatggttccaatgttccagtatcacggttatttagtcgaattagaatacagggaatacaaacttcccgaaagctttccctgcatagctcttctgcaaggcgaattctccttctcccccggaagcagcggtcccctgacctacctccatttccacaactgcgtggaaatcggaatctgtcacgccggcggaaaggacctttatgtagaagacagtcatgagcgcttctgcaccggtgatatcagtgtaatcccgccttataccatccatatctctcaaaaccgggagggacaggaaggggaagactgcgaatatctctatttcagtcccgaggaacttttaaagccgttctatccaaatggtctcccggagcatcttctctggtataacagaaatcagggctgctcctgtgtatttcccatggagcgttttcgtgttctgtatcagttgatcatttctgtattcgatgaactgcgccgaaagcgtccttactatcataatactgtccgcggactgattctggccatgatggtagagctatcccggatcaacggactggaaaataccgttcattccttcgagaggctgcgggatatgacgccgattcttcctgcgctggagctcattggcagcaataacgcctcttttatgactaccggtgagctcgccggcgcctgccatttaagcgtcgcccagtttggcaggatctttaaacagataatgacacagagccctgcggattacattcgaatggtaaagctccagaaggcgtgcgagctgctctacagcacggaaatgagcatcctggatatcgcattggaatccggttttcagtctctctccgcctttaaccgcgcgttcctcaagtcttaccagaaaagtcccagcaaatggcgccaggaaaagtgcagcgtccggaagaaaaatgtcaggtattccccctatcttcccagcgtacgctctaacctttgatgccgcccgcattagccattcctttaataatctgcttctgtgccatcacgtacacgatcaggactggaataagcgccattaaggtgcccgccattaaaagtgcaaacgaagtactgtgttccgcctggaagtatttcagtcccagctggagcgttcttttgctgttggaggtaaggaaaatcagtggggccaggtagtcgttccagcagcccataaatgtgaatatggtcagtgccgaaagccccggttttaccataggcaggatgatcctgaaacagatttccagatgggtacagccgtcaatctttgccgcttgggagtactcctccgaaatccccataaatgcctgtctgagcaggaatactccaaatggagtgaagctctgggtcaggattaatgacagatgggtatccgccagcttcagcttcgagattaccataaactgagggatcatgatgacctgccatggcaccataagtgtggccagatataaaaggaacagctggtcccgtccgcgatagcggagttttgcaaaggaataggctgccagcgagctggtcagcagtgtcagcactgtaataatgaccgacagcctgattgaattccaatagtaattcaaatacggaattttcgtaaatacatcctgaaaatttttccagcggatcgaggaaggaatccactcgatgggaaaccggaaaacgtcctgctcgaatttaaacgcggtggaggtcatccacagaaatggcaggattgtcactgccgcaaaacaaaagaatacgaggtaagataacaccttaccggtaatacgttctgctgtactcttgttcataggaatctcctctctaataatttacccattttttctgtccctggaactggatcatagtcacaataaatacgagtacgaataacactacggcataggccgaggcataaccaaacttgtagttctgaaaagcttcctgataaatcctgtataccagaacattggaggaacgtcccggaccgccgtctgtcataatatttaccaggtcgaataccttgaaggaattgatgatgcacatgacagtacagagaaacgtggttggtgataaaagaggcagcgtaatgcttttaaactttttccatggacctgccccgtcaagggaagccgcctcataaagttcttctgagacagactgtaagcccgacagaaacaaaaccatataataacccatatttttgatgattgagacaatggtaatcgtcgtcatggaccatgcggtcgaagtcagccatttcggcgggtttgccattcccagtatggtgagaacgctgttcaccggaccttccccgcgaaacagcgccataaagatcacgccaaaggccacgctggatgttagctgcgggaagaaaaagattgtcttaaatacttcgcttccctttagcttctgctgaagcagcacagccagcagcagcccaaataatagtgtgagtgtcacactgactatggaataataaatattatttcgcagcgatgtataaaaatagtcgtcgcgaaacagcttcttaaaattagcaaggcctacaaatgccgcgtcactgaatccgtcgtaatttgtcagcgacagcagcagtccccaaacgaccggtaccagtgtaaatatgaaaaaaccgatcatatttggcagcagaaacaagtaaccggctatttcttctctcctggccattttcgaaattttgatttttgttttcttctgattcttcaatcgtaccactccttcctgcgtaaacccgtgcagacggatatccggcttatcagccggacatcgcgtctctcacacgtttaattgatcacatcagctcttctcgattcaaaatttttcatcgtggtatcgatatcctgctcaccgaccatatacagctccatctcttccttcaggatcgtctctacctcagcatacttgggatggtattttgtatcgatggcattgttttccgagaatacaatttttgcgagagtgtcgtcggactgctccgctgcctttaagtaaatatccttgatctcgtcatcattgtacgcggtcagcgtactgttttctgcaatgatcttagctccgtcatgagtacacatccactgaataaaatcgtaagcctcggccggatgtttgctggtctttgatacagagagaaaattcatggagcacggcgccgtatagtccctggagccttctggaattggcattggcattactttatacttgaatggcatttcaccgctctcatactttagattgtaagcagcaacaccccatgtaccattctggaacatggcgacagtctcagccggagctgtggtgaaaagtgatcccacattctgccccatctccagtttttcctcaaacggtacgtgacttccatcctcgtggagcgctttccagagttccagattttcccggataattgtggtgtcctcatccataacacttccgcccatctgctgcatatagacaaaattatccatgccaaccaggccgccatacgttttgtccttcgtcagtttttttgccagctcccggtactcgttccaggtaagctgctctgtaggaacgtctaatccggctttttcaaacagctcctcattgataaaaagcagccataccgcctgacggtaaggaaggccgaagatcccctcctggttgcactcctcgaatacctgtccgtatacagaggtatccagcccggactgctctacgtaagaagtgatatcctgaattgtcttcttattctgataatctccgtagggagcgattccattgacacccaaaacgtcgaactccaccccgctggagaaggacgccaggatcttatctgcgtactcggtcggcgggaaataaaccacctccacctcggccacgtcgctctgggcattatacgccgccacggcaggatcaaggtatgactgctcatcactccaatcatagaatgtcagctttactttttcaccgccgcccccggcggtcccattctcagcccccgcctcagcctcggttttgctctctgtcttcgcgcccccctctgttcctgcgctgccgtttcccgatccgcatcctgccagtgagaatgccatcacgcctgccatgccaagtgccagtaatctttttttcatcatcatatacctctcctttttttatttgaggatctcttcgatccgtcttttctcttccgatgtaaattccctgttcttcagtgcagccacattttcctccagctgtgccagtctgctggcccccaggatcacgctgctcagcctgcccgcttccagagcccataccagagccatctgagccagagactgcccacgctccgcagctacttcatttaatgacgaggtcatctccaaagtctcaggcgtaatctgcttctctgacagaaacatactgtgtccggccgctctggaatcccctggaatcccatttaaatatttaccggtcagaatgccttgttccagaggacagaatgcgatcgcccccatccccgacgcctcaatgacaggcagcagtttttcattttctctgtacaccatggaatagtgatgctgatgaatggtgcacggaaccttcagttccttcaaaattgccactgcttccataagctcttcccggttgtagttcgacaatcctatgtaaagtgctttcccctggtgcaccagccccgccagcgcatccattgtctcccacaacggcgtctctttgtcgggcctgtgatggtagtagatatccacataatccagtcccatgcgttttaagctttggtctaaggaagccgtcagatattttttggaaccgccgtctccgtaaggaccaggccacatgtagtaccctgcctttgtggaaataatcagttcatcccggtattttcccagatcgctctgcaaaatctttccaaaggtctcctctgcggatccctccggcggcccataattgttggccagatcaaaatgtgtaattcccatatcgaatgcgcccagcaccatttccctggcattgctgtatgtgctcccatatccgaaattatgccagaggccaaatgacatggccggaagctttaatccgcccgttccgcaccgattgtaaaccatagtgtcatagcgggtatcctttgccgcataattcataacctattctcctctcccatatttcccggctgcttcgactacccaggaaatcctgtttaaatcaatatttctcggaagtgtacagtcggcgccgataaccactcctctggttccgtgtttttcaagaagtgctgcggtatacgcctccacttcctccttcgtcccggagcaaagcacgccctgaggcctgttatcaaatccgcccagcacacatctgccgccgaagaatgcctttccctctgtcaagtccatgtcttcgatgaaggtggcccagttgatcacctttgccggataatcctgccacacctccacccggtttttatccccggcccatccacagcagtgcagaatattattatcactgaaccggttagcgtgctctaagacctttaaatcccccggtctcacgtacttacggtactcctccgccgtaaaacggtactcctccgcattctgtacacagtaataaattcccgtacagccagcttcccggatcagcagttcggacagaagcgccgcatcctgagcgatgacgtccatggcataaagtactgcctccggattctgccgcagatgattcatcagcagttcatcggatgtcgcgaaacgcaaatatgacatggggcagaatacgttatagaaagcgcacgcctctccgtccaatctcttcacaatctccttcgcccgtttcacctgaccggtaataaatggatgatcctgacccatagggatcattttaaaccagtcttccggctcttttatctgggaaattatggaattcggataatcaaaatacccatcgcacataattttcaccatatccacattacatcgatggaaataatcaatatgtgcatccacacactcctgatccaactccatatcttccggcagatggaaccagaatcccactggtacccggtctactttctcattctcaaatgccttcatcaggcgctctgtctttgtcatactttcctccaattttctgtcttaattatttatataaccacatacacagctgcaggcagtcatatatgtctgtctaagtcaatcaggcacatggtataaatggccatggcttccaaaagctggctgatacagatcgactcgtccgcctgatgaaagtcaccgaccggccgtgccggatccggacggtataccttctttcccggcagcgccatgccaaaccccagacctcccggcagctttcttgcataggtaccgccgctcatcgtgtatgccggattatcatagccagaatatttatggtagctgtctgtcagacactgcaccaccggattatcagcagggcagtacatggctcccgaattcttcctgacacacagcctcagaccgtaacggcgggccgcctcccgcattttttccagagtctccgaaccgtcggagcaggcgccccggctgtctagaacaggataccggtagtttgctgtgattttaagccttctctcactgccggaagtgactgccaggccggtaattccccccaccagacagccggataccgtatccgataccgcagcgccgattcctgtcccgtagccgtcgcgtccgcagtcacgcaaaaactctatccattgattttctccggcactcctctcattcaggccgcaggccatcaattctttcgcgagaattgtcaccgcactttttccctgctccggactgatgatgtgggccgctcttccggaagcttccactacagttccatgttccccatccataaccattatttcgggagataaccggagacgctccttctgctcttttgtcactacgccggagcgatatacgatacgagcctgatcgggaatcgagttggcactgctgcccccttccacggaaataactgtttcgggcagaagctcccgtgtctcaaacaccagacttaaattccccttttccccatggcagaccggaaatccgcagtcggccaccagagacacctccggcattggtacatgagcaatcatataggcggcatcatccatcgtattttcctcactgcatcccacatagagactgtaattgcagttaagggaaacgaattctttcagatagagcagcacatagaggattcccactgccgatgatttattgtcctgaacgcctctccctatgaggaaatcatccacaacagtcatatcatagggcggataggtccagccgtttccctccggcaccacatccaaatgagaccagattccaatttcccttccactgccggaagcaaacgatattttcccgccgtaataattgaagcaatccgttttaaagcctttcccggccgccagttccagcatggtatccagtaccttccggcatccctttccaaacggaagcacatcggagtccggttctgaaacactgcggatatttacaattcttcccatatcttctataatgtcattgcgatgactctccatccatcgccttacagcatcgattccagtttccgtcatataacctcctttccttcttttacaggtatcattcctttcatttttgcaggaaggattgtctgtactgatacgagaagtatagcggatgtaatataaaaattctttgcatgaaggagcgaaaactatgcaaaatcgatcaccgtcatcgactgatcttcaatatcgccattataatcttccattggaattcccttcctttgctttcctgggagaccggtggattcttcccgatcatgccgattccatgcattttcacaactgcatggagatcggatactgtttaagcggtcatggcacattctacgtcgagcagaaggctcttgcattttctgaaggtgatatctgcatcattccagaaaatacaattcatatttcctgcagtgacagccgcgtggtcagccactgggagtatatccttttcgatcccaagcttatgtttcctaccggagattttcacttaatcgcaaaagacagccgccttctctttgacgatccgcagttctccaatttattttcgaaacaggagcatcccgctctgattttctttgtatgcaggatgttcgaggaattctatcaccatgaaaccgggtaccgggacgccttaagaggccttttcatggcctttattacagagtatctccgcatctgtcccgatcggaaaatcagcggcgaggctaggcagaatctgcgtatctatccagctattctgcacatccgaagcttctacagccagaaaataaccgtgcccggtctggcggcactctgcggactgagcgagcctcattttcgcaggatctttgaggaaatcatccatttgccgccgctcgactatatccatcatctgaggatccggcaggcgtgctactttctggtacatacaaatacacccgtcagtgagatatccaaaatggtgggattttccacactctccagctttaaccgccagtttcagatggtaacgggcacttcaccgcggaaatggaaggcaaaaaacagggacagcatggaatcccaccggataacgtcacttgattccggagaagatatgggcttttttgcaagataacaagagctcccggcgcacaaaaagaacccggcaggcataaaaatcatgcctgccgggttcctctgtaccgaccagataccttattcttttcgtttctgccgcctgtctctattccagtgcctggcggatatcttcaataatatcatccacgttctcgatcccaacgctgaagcggatcatagaaggatccacgcccgcttccaccagctgctcatcggtcagctgtctgtgggtatggcttgccggatggagcacggaagtacgcgcatccgcaacatgagtcacgatggcggccagcttcaggcggtccataaatgtaacggccgcgtcgcgtccccccttcagtccaaaggaaattacgccgcaggttccgtccggcatgtacttctgagccagttcatagtacttgtctccctttaatcccggatagttcacccactccacatcatcgcgggattttaagtattccgccacgcgcagcgcgttctcacagtggcgcggcacacgtaaatgcagcgtctccaggccaagatttaaaaggaatgcgttcatcggtgactggatggagccaagatcacgcataagctgagccgtcgctttcataatataggccatctttccgaatttctgtgtataaacgatgccgtgataagattcatccggagtggtcagtccggggaacttctccgcattcgcttcccagtcaaaattgccgctgtccacgatgcagccgcccacgcaggttgcatggccgtccatgtactttgtggtagaatgggtcacgatatcggcgccccactcaaacggacggcagttgatcggagttgcaaacgtattgtcaataatcagcggcacgccgtgtctgtgtgccgccctcgcaaacttttcaatatccagaaccaccagggccggattggcgatagtctcaccaaataccgccttcgtattcggcttaaatgccttctccagctcttcctctgtcgcatccggatccaccagagtcgaatcaattcccagtttcttaagtgtcacggtaaagagattggtcgttccgccgtagattgccgcagaactgatcacgtgatctccctccccgcagatatttaaaatagagaaaaatgacgctgcctgtcctgaggatgtcagcatcgcagccacgccgccctccagttcacatattttcgatgccaccgcgtcgttcgtcggattggctaagcgggtatagaaatatccctcgtcctccagatcgaacagtctgcccatcttatcgctgtcatcatatttaaatgtagtactctgatagatcggaagtactctgggttctccgctcttcggctgccatccgccctgaatacaaactgtctctctggaacgcttattctggctcatgattcttcctcctgtgttgttaagtcatattttctccctagtttatcacaaaattttccataattcaatatccagaccgggggagttgcggaaacgtaacaaatgcttatgcccgaaaccggaaccggaaaggtccaggaaacgaaagcgccgggccgggcagcagcagctggaagtgaaggctgaactgttacgcggaaacaatgaaaacgtcttgaactcctccctcatttacagtataatatctagatggaaaattttatcaatcacgcacaggaggtgcacatggataaatcaaaggtttactatacaaattttcacaccacattttcagaaaatctgccgcagaagctaaagaggcttattaaaactgccggcatggagcagattgattttcagaacaaatacgcggcaatcaagattcattttggagaactgggcaacttatcttttctccgtcccaactacgcaaaggtcgtcgcagacctggttcgtgaaaacggcggaaaaccgtttctgaccgactgcaacacactgtacgtcggaagccgcaagaatgccctggatcaccttgacaccgcttacgagaacggtttttcccccttctctaccggctgccacgttctgatcgccgacggtttaaagggcaccgatgaggctctggtccccatcgatggtgactacataaaggaagcaaagatcggacgcgccgtcatggatgccgatatcttcatttccctgacccatttcaagggccatgagagcaccggtttcgggggcaccttaaagaacatcggcatgggctgcggttcccgcgccggcaagatggagatgcataacgccggaaagccccacgtcgcgcaggatacctgtgtcggctgtcacgcctgcgagaaaatctgtgcgcacggagccatctccttccaggagaaaaaggcctctatcgatcacaatcgctgtgtcggctgcggacgctgtgtcggagtctgtccggtagatgccgtggagacagactgtgatgagtccaacgacatcttaaactgcaagatcgcggaatacacgtatgcagtcgtgaaggaccgcccctgcttccatatcagcctcgttacagacgtctcaccaaactgtgactgccactccgagaacgatatcccgattattcccaatgtcggcatgttcgcctccttcgatccggtggccctcgatatggcctgtgtggacgccgtcaacagccagccggttattgcaggaagcattctggaaaagcacggcagcgggcaccacgaccactttactgacgttcacccggataccaactggaaaaccgcagtagaacacggcgtaaaaatcggtcttggaaataaggaatacgaattgattaaaatataaatacggatcgccttatcatcattggaatcgcgatggaatcacaatggaatcacaataaaaagaatgcctgaagcagactggatcaacgtatgatccctgggtttgcttcaggcattctttccatgaaacgttaaaagtgcgttttcgagggcagtggtacaggggattggtggaacctccaacaagtgccataataggaagttaaggtttttttgttaaatacaatgttatcgtatcacaaaaatttattttgtcatgatgctttaatatagccgctcttataccattgtagaaattagttctgtatggttcttgcaaaacaatatggtcacagtgtgtgccaagatattcaatatagctttcagcattgtaggtgcgttcgctttgaaacttatattcttgaaaatctacaaaaccataattaagtgcattgcgataaataaagttttgtgtgtatggtgtttctggcttaaaatatgtagaatacacttcttgtaattcagtatagagtgtttcgtttggcgtcttgtaatctccgtgcaacatcatcatagcaagatagccgccgctttttagcagttcaaagcttttagaaaaagcaatttgttctggtatccattgaattgccgccgctgaataaactaagtcaaactttttatccccataatcataaagtccaaaatcgccatttacaatatgaaaattattatagtctttaaacttgttttccataaacctataaaggttttcaccaagttctattgccaaataatcacaatttgttttaagaattggttcggtcgcttgccctgttcctgggccaatttcaagaacagatttagaagaatcaatcgctgcttggttgattatacagtcaaatgcctctttacagtattgaggtctccatgtgtcaaacttttctggaattgtgtcaaacactttcctaaactccatttcgcatacctcctatttttattatatcattccatttaaaaatacggtagatggttttgcaatcatctaccgcattctattttcgaatgttttgtaataaactgcttctaacactatctggagaatgaattctcccagtctacatcccccgcttataccgcccgcacagctcccctttttgcagcacatgcccttccatcgccttcagaagctcctttttccccgcagttccatccagcggaagcaggcagtcaagggcataaaaccgaaaaacatatctgtgcgtattcctcacaaaaacaggctgcttcggtccccggtatctgttttttccatacccgcgcccctgcacggcatttcccagttcttttacaaccgctccacaggggatattttccggaatcacggccattgccggaaggttccagatcagccagtgattataagccgggataaacgggatatccagatcatccataatcacggcaaccgaaaccgcattctcacagagattctttaactcaaaccccggtgatatatctctgccaaagccggtatactccctgggtatatttccgttattctcaaatgcccggcacactgccttcaattccctgtcgtcgctcatgatcctttccccttttctctgactccctctcccagcggaatcttgtcccttccgatctgccacaccgtaatatcggcatccgtgacctttttctccggaatattcctggcaatgatcagttccggccacacaaaggtggtctccaccgcctttccgtccaggcagattttggaatatggtgtaaaattctcaccatataccagaatattagaatcgttatacacaatatcatcaatggtgatgggatcgattcccatctgtaaatccgtggtctggtagggattttccccgccgtagacctccctgtctccgtacaggatatcgtattccagcgctttcatatcggccagatacgtctcctcatcctccatgccgccatccagatagttctgatggaaccgcatcatggttccctcatgaatccccagcatatccagcacgtgggcggccagctgatacgcctccacatccaccttcttcttcggaagattcatattgttccagaccacatactccgtctggtacagggatttgttgatcatctcatcctccgtccattcaaagctgggaaggtggtctccgtacatcacaagtacgatgggctcctccctcgtgcgaagggtattgacaagcgaacggatgaaatcatccatctcaccgatctgttcacagtaatacttaaaatccggatactttccatggccctgtaccgatatggtatagataaaatcaggcccctctgtggaatccagcgtccctataatctccttcaccaggatcttgtccttgcaccatccggccggatttctctcaatattgttcatatattcaatgggcgtaaacgtatcgaacccgatctgcgcgaatacattgttcctgtcatagaaggtcgcctcgttgttgtggatggcgtgggccgagtagcccagattctttaaatcaaaggccacactctcgcaggaggtctttttcagcacggttttataaggatactcgcccggtccgaagaaatccagattcatgcccgtgatggcttcaaattccgtattggccgtccccgcgcccacggaaggcacattcaaatatccatggggataatttttctgcagctggtggaaaaatgggatgggatcatagttttccgtcccaccggattccggattgcccgtcaccggattcttcttccacaggagcgggtcgaaaaaggactccagctggatcataatgacattcggcttcgtactggccgagaccgcatatgtattttccggaaccagttcctccgccttaatcacctcgatcgtctccgtaccatagtcctccggcttggagattcccgtgttgaacatggaattggcaaagcagtaggggaacccgtacgctaaaaatgccgctccgatattgccgaaacgcaccgccaccagcccggtgttcatggcagctgtcgtcagtcccaggaccaccgccgcgctgatccccacaaccgccgtgcccttgacgtaattgaccttttcccggctcaccggcgcaatccgccacacaaacacgcagaagaccgccaccaccaccagagccgctgctatcataaccagctgcatccaggtgaaatacgtggtcgcaatattggccgcgtacttaatcagcctgaaatccgccgccgtaaacggagtcgtccggaaaatcaggagtatcccattcacgactcccattcccagccagacaatcgacagcacgattgccccaaacaccctgcgcctcgtaagaaacagcaccgtaaacggcagggcgataatacatgtattcaaaaggaagaccagcggactttccaacacgtaggccaaaagcactgcaagcgacttcctgctgataaactcgatcaaaaaatttaaaacagctgccagaatcacaatcttccccagccgtttcccatatgccttcatggcggatctcctttgtacctcatcgtacttcatttctttggaatcggatttagtctaccacactttacttgaaatttacatacctctttgcaaaatttaggaaaaatgtaaaaaacgggcagcggtccgtgatcctaacaaaaaacagagtgccatacggtctcccgcatagcactcctgataccttcactctttttgattatgtttaatactcttccgtcggaacaaatgcgtcctcttccgccgcaggaacgccggctgggcgctctgcttcttcctcagaagccgcctgttcttccgcagcagcatccacgtcttcgctttccgccgcttcttccttaatcgaagcaccgcatttgccgcagtataaggaatccttcggaacctttgcgccgcagactgcacagatccggctgccttcgctctgggtcagttcaatctccagggctgcgatccgttccctgcatgccttgacagcatcgtataccttggcataggcctcttccggctcacggttggattcgtaatagatccgtccgatggcggcataggcttcctccagcttcgtcttctccgtgctgatctgcgtctttaactgtatcgtctccgtaagtgcctttgccttcgtggccacttctttgccggtatccgtaagggtctttcccaattcttccaaaaatgccatacgtagttcctcctttgacttgtcactcttaccattttatcgtcattggaggaaaaagtcaatcagagactgtttccacttctctgttaaaacgctccgactccttctttaagaattccggcatatctgctttgcggatgctgtaatcgtggctgatctgcccgctgctgcccttcaccaccgcttcaaaggtgatccggtcatcccattcactgaacgggttcatattcgagtaatcctccagcctggccgtctccatcagagccgccacttcttctttgtccgtaaccgtaagctgagaagtaatatccttatcgtaatatctcgagtcatctttcttcgtcagctgatagagatcaatatcggctcttatcacctcgcccgcatcggttacagtagtcagcctgatgccgcagtcctccagcagtccaatggtcttctgaaaggacgggtataccgggtagtagcccctgtccatcacattgttgtatctccaggaataaccgttcttttcctttgatttttccgcctgcacctgtatgtcagtcataaactgaatctgggcgatcggattctgctgctccatcacgtctgaagtcaggcctgtcatctcctcctgataggtgcggagtatcaggtcgacgtaatccgccccctctttactgctgccccgggtcacctctctggtccagctgttctgtgctaccttgatctttccggtattctccggagtctgttccagcaccggataagccgccatgcggtaatcctggctgtcatagatcttcctgatgagatcgtattcctcttcaccatatacagcataggaacggtacacttctctgccattcttcagtttaaacttcgcagagaagctgacgtaatgatctccatcctcagaatcccactgatactgacgctccttctctttttccacctggctgaccgcctctgagacgagagccagcgccgtgtccatatcggagagctgcatacgggagaagatgtatgtgtcggaagactcgtaatcccagtaatactcatcttcatcgtccattttcgcacttccgtagtccacccagtattccatattcgtcagggagactgccacggattccagatccgactgcttcggaatgtacttgtcgtagccaaataagtcaaagcggaacccacagaatatcagtgccgcggcaagtgcacacaccgccatggaaatcctgctggagaacagcttccggaaatcaaagtggtaaatgatttcgattatacagtgcgacagcagcaggccgcagatcagtccaaacaccgcccatccgatactgtcatgcagataccagaagaacagtccaccgcagagtgcggagaggattacaatcggaatgcggataattggctggcttaccttaaacgccatagcctttccggccgcctccgaacctctcacacggtaaagcagaaccgctgccgccgttaccgccgcgatgacgagaatcaccgcgcagatccttaatacaaggcttccgctcttcgccccatccataaatgccgaatagttgctgatatacagcgtcagcgcagagcatttatcgagcagcttgtatgtgatactgcttccgccgttatagctggtcttaaaaaattcctgatacagcgcatccagaagcaggaggagcgccggaaaatacagatggaacacgccggttcccaggattcccaccaggatattgccggtcatcaccatggccagcacggtcacggaatacagcatgataaagtgaagcaggaggaagccaaacgcccccaaagcctccggaacgatatccccggggacgattccgttcaccagggcaaccagtaagcccagcagtaaattgaccgcatatgtagaaaacaggatcagcactccgtccagataattcacaaaaaacagcttttcacgctttaccggaagcgagtggtagaaatccactttttttctggaatgcagccaggaaaaactggtcacgcccagaatcagtgacagcagcacgataatcactgctatgaatccattttgaaagccgagaatcgaccgggcgccatacatcaggccgtagtacgtttcctccatgtttctgctgccgctgagactcaaagccgtagccacaggcagcgcaaagaagaaggttaagaaggtaagagccaccgcccagaggcgccgcttcaagtcctctttcatcagattaaagaataagttttttgatgtcatatcctgccacctccgtctcactgataaatatctcttccagggacaatggaataatctcataaaataccggacgataggactccatcaaagattccgcctcttcccggcttcccctcacggtgatggttataagctttcctcgccgctccgtcttaagccggtcgaatgccaccagatcatccgcgtccattccctctctcaatacgcactgaatcttatgaatattgagtttcatatcatccaaatccttggacagcaggattcctcccttgtgaaggagtcccacatggtcacagatatcctccagctcccgcagattatgggaagcaataataggagtcagattccgctccgatatgtcgcctgcaaatatgctcttcaccgcctgcctcatcacaggatccaggccgtcaaacgtctcgtcacagaacagataatccgtattcgcacagattccgcagatcacggacagctgcttcttcatacccttggaaaatgtattgacctttctcctgccgtttaattcgaaaccagacagcagcttgtgaaatctggtcttatcaaacttcggatagacacggctgtagaactccatcatctccagcggagtcgcattgctgaaaaaatactgttcatccgatatgtagaagaaccgctgcttgacgtcctccctctcgaatacattctttccatcgatcgtgacgcttccctcatcaggttttaaaacgccgctcatcatccttaaaaatgtgctcttccccgccccgttcgtcccgattaaaccgaacacggaggcgtccttaatctctgcattaatatgatccacggcaatcatatcatcaaaccgtttcgtcagattctccgcttttatcacgctgctcttcctcccttaccatagatttttgtcccttccagtcctcggtgacccagcagtgaaccttatcctccgtcacccctgcgttcctcgcctcaccgagccagccgcccagctcttttcgcagctcgctcacctttaaagccctgatggaactcgtatccgatacgaagcttccccgcccctttacggagtaaataaagccgcgtcgttccagttctgcgtaagcccgctgtatcgtgttgggattaatggacaaatccgtggccagactcctgaccgacggaagctggctgtcctgttccagaacaccgcatatcatcaggtcctgcagcttttccacgacctgctcgtaaatcggtctgcggtctttgtaatccagcagaatcatatggcacctcctatactgtattaatacatctaatacacctagtatacacgaacacccccggtttgtcaaccggaggtgctaaaaaaacagtaacaggagtcatccattaatttcgtctgtcttccacaatcagaatcctgattgcatcctgagaattgttccagttaaacacatagagtgtataggagacatttcccctgatatagatattggaggtcaaaagcgggcttcccgcaaacgccgagctgttggagacggaaaccgtatagtatccggccggcagatatcggaagctggtcacttcgcggtaattcacgttgcggaaggtaaccgcgccgccgttcagcgtgacgttgacgctgcggttcgtattggataagttgcatacgcggaagcatcctgtattcgctccgccgttgcagttcatatccgtgatctccattaagtccagaccggtattcgtattgatgatggctacggtgattgcgccgtttaacggtacgttgatctgcttctggatgtagacgtagccgttctgtcccgatacggtgacggtctgcataccggcggatacgcggccgtactggctgacctccgcgttgtccagaccgtttaccaccatctggttgttgatgtaaattatgaatggattatatccggcggcggcatttaagaaccgtacgacgccgtactgagtggtattgcagaagtaacagggaatgatcggtctcgggaaaacggtgatgatcgaaccccagatcccattgtttggtctctcgggaaacgttggaatcggtccgccctctccggggtttggcagcggaatcaccggagtctggctctcgtcaaaatcaggaatcggcccgccttcgcctggattcggcagcggagctaccgggaaattactctcgtcttctccatccggcaccggtccgccctcgcctgggttcggcagcggaatcacgggtgtatctgcatcattctgcatataagataaagtgtccatattgcccctcttttatgtttattatactttaagtttattccaccttatcttcccagtgcctgtaccggagcaaatttatcttaaattttacaaaatattttctaagaggccgtaaccgcgtccccattctgattatttctgcccaaaagcctgcgcagacgccccatcacatggcggtaggccggaagcagaaacagatccgccgccacccaggcgatgggattggcaaagcatacagctgcgtatccaaagaccggaacgagacagaatccgacaaaggaccgcgccgccatctcacagactcccgcgatgatggcaaatttcgaataccccagcccctgaatcatgaatctcacgatgttgacgagggccaatgggaaatagaacaggctgttggcaaccaggaactgcttcgtattcgctaaaatctccacttcccccgcatccacgaacagcagggccaccacatcgctgaagagatagagcccggccagcgcaatcaccgaatagacagccccgatgataatacaggacttgatccccttgtcgatacggtccagctttctggctccgatattctggcctccgtaggtagccatggtagcccccatggcgtcaaaggggcagcagaaaaacatactgatctttcctcctgccgtgacagatgcgaccgccactgaccccagggaattgaccgcggtctgtaagataacgcttccgatggccgtaatggaatactgaagtcccatgggaattcccatgccgcacagcgtcatcatggcattcttatccggcttccactcgtccccctgcatctttaaaatcgcaaacttctttctcatgtagagcagacagagaacgccggagacgccctgggagatcaccgtcgcccatgcggctcccgccacgcccatatggaggacgagaatcgtaaagaaatccaggaaaatattcataatcgaggacaccagcaggaagaaaagcggcgtggtgctgtcccccagagaccggataattccggacagaatattataaaggtatgtagccggtattcccaaaaatataataaaaatgtaggagtacgccccgtcgataatgtccgccggcgtattcatccagataaggatattccggcacagcacacagaccacggccgtcatcacgaccgcaaagatcagagccagccagcctccgttggcgacaaaccgccggagcgcgacctcattcttctctccgaacttctgtgccaccggaatcgcaaagccgctgcacacaccgacacagaacccgataatcataaaattgatcgagccggtggatcccaccgcggccagcgcattcacgcccagatacttaccaacgataatggtatcaaccatattatacagctgctgaaacagcagaccgaacagcatgggaatcaaaaagctcaatataagcttcatcggcgagccggttgtcatatcctttgtctgcttctttgccatcgttttctgtcctcacttgtttattcagattttctgttcaccgcaccacaaaagtatgatgctacatcaacataatttacacgcagtgcgaagaatttgcaagcgaaatttttccattttaccctgtatttttccattttcgtgaattttatcacattacacaaaatatccgccgaatccgcccaaaatataggacttctttcgtgtcacttcacgatccccagccgcctcatatccagctctaagtattccaggggagtgaggcgttccctgactccggctgctgacaggccgccgtttccgaaaccggcagcccggagaacgccgctgtttgcaaaccggcagtgggccttctgatactgtgcttcccgatcggtctccacaggcgctgcccagagaaaatccatgatcctgtttaatgcggccaccggccgtctcccatgcgtctttgtcacggtaactgccccggccttccggaaatacgcgtccgtttcctgttccgtatacccctccgccaggaatcccgttctgatcccctgcgccgctgcttccgtatagttgtcccattcccaggcactcagattacagagcaccaccgtatagcagttggaggcattgactgccgtcagcgcccggcctccctgaagcacaatcccgtgtaactcccagcagtagcacagctccctctcactcccgtaaaatggggcaggtatcttcagctgtctctgcaaagggatcgtaatcccaaattccatcatcactcctccaatcttaataaagagtccggcatgacacattttcctacatgaaagagtccggctcgccaggctctcgcgccggagcgcggtcgcttcagcggccatacttccttagcgcggagtgcgcatcctcccggaggttttttattacataggacgaactttcctgtgaaatgaaaaaaacgcccgggcatactacccgggcgcagtccttcaaatcttatttatcaccatacagtgtaacaagctttgtcagataatcatatctttccttcgcatctgcctcgttcttagcgaacagatcagctgctctctcaggattcttcatagctaaggaagcgtaacgaacctcgccctttaagaattcctgataatctcctgtcggagccttgctgtccagagagaatttcttctcagcagccgggttgaaacggaagttattccagtatccacactcaacagccagcttctcttctgtctgagccttgctcatgcccttcttgataccatggttgatacatggagcgtaagcaatgattaaggacggtcccggataagcctctgcctctgcaatggccttaacggtctgtgcatagtcagcacccatggagatctgtgctacgtatacatagccatagctcattgcgatgcttgcaaggtctttcttcttaacttccttaccgccggcagcgaactgtgcaacagcgcctgtcttggtagccttggaagcctgtccgcctgtgttggagtaaacctctgtatcgtataccatgatgttgatatccttgccgcttgcaagaacgtggtcaacaccgccgaatccgatatcgtaagcccagccgtcaccaccgaatacccactgggatttctttcctaagaaatctttgtctttcacgatggctttgcaggtctcacagtcacagccttctaatgcagcaactaacttatcggttgcagcaccgttggttgcgccgcatgtaaaggtatctaagtattccttgcatgctgcttttacttcctcagaagctgcttcagagttcataacggactcaacttttgcctttaagccgtctctgattgcgttctgagctaataacataccgtaaccgaactcagcgttatcctcgaataaggagttggaccatgcaggaccctgtcccttttcgtttactgtgtaaggtgtggacggtgaagagttgccccagatagaagaacatccggttgcgttggcgatgtacattctgtcaccgaataactgggtaattaattttgcgtaaggagtctcgccacagcccgcacatgcgcctgagaattcaagtaatggctgtttgaactggcttcccttaacggtggtaggtttgaatttgtcgataacttcctgcttgatcggaagagtctgaccaaagtcatataccttctgagattctgcgtagtttgcttccatgttgaccatggtaagagccttctcgcccttcttgccaggacatacgttcgcacaggagccgcatccggtacagtcaagagcggatactgtcatggagaacttgtagccaggcatgcctgtcatatcaagcatctttgttccttctggagcctgtgcagcctcttcagctgtcatggcaaccggacggattactgcatgaggacaaacgtatgcacagaagttacactggatacagttgtctggattccagttaggaatattaacagcgataccacgtttctcatacgcggaagaaccggatggtgtggaaccgtctacatactctgtaaatgcggatactggtaaggaatcgccctcctgagcgctgaccttagcctggatgttgttcacgaagtctacaacgtccttgcggccgctggctgcgtgagtcatgtcaagaccttcgtctccgcaggacttccagctctccggaacctctaccttaacaacgcccttagcacctgcatcgatcgctgcccagttcttcataacaacgtcttcgcccttacgtccgtaggtagcctttgcagctgccttcatcagttcatttgccttctcagcaggaatgattcctgtcagctcgaagaatgcggactgtaagattgtgttgatacgtgtcgggcccatgccggtttcgataccgatcttgacaccgtcgatggtatagaggttgatgttgtgatcagcgatgaacttcttaacctgtccaggtaaatgcttctcaaggccttctgcatcccatgggcagttcagtaagaatgtaccgccgtccactaattcctgaaccatgttgtacttacgtacataggacggattgtggcatgctacgaagtttgccttatgaattaaataggtagatttaatcggcttatgtccgaaacgtaagtgggacatggtaacaccgccggacttcttggagtcataatcgaagtaagcctgtgcgtacatatctgtgttatcaccgatgatcttgatggagttcttgttagcacctaccgtaccgtcggcgccaagaccccagaacttacagttggttgttccttccggagtagtaaccagaggtgcacctgtctcaagagataaatgagtaacatcatcgttgatgccgatggtgaaaggtgtctttgtctcgttatcgaatacagcaacgatctgagccggtgttgtatccttggagcctaagccgtaacgtccggttaagatcttaacctgatcgaacttggttcctcttaaagctgccactacatctaagtataacggctcgccaagggatcctggctcttttgttctgtctaatacggagatcgtcttaacggtatccgggattgcttcaacaagagcgtctgcgcagaatggtctgtaaagacgaaccttcacaacgccaaccttctgtccccgtgctaccatgtagtcgatggtctcttcgattgtatcgtttacggaacccatggatacgattacgtgctctgcatccggagcgccgtagtagttgaacagcttataatcggtaccgatcttagcattgaccttgtccatgtatttctgaacgatagccggtaatgcttcgtaatatggattacatgcttctcttgcctggaagaagatatccgggttctgagcagaacctctctggcagggatggtttggatttaatgcatgacgacggaactcgtccacggagtccatgtcaaccatctcttttaaatcttcgtaatcccaggtctccaccttctggatctcatgagatgtacggaaaccgtcaaagaagttgatgaacggaacttttccttcaagagctgccatatgtgcaacaggagttaaatccataacttcctgaacgctggattcgcataacattgcgcagccggtctgacggcatgcgtatacgtcggagtggtcaccaaagattgataaagcatggcttgcaactgcacgtgcggaaacgttgaatacacccggtaactgctcgcctgcgattttataaaggttcgggatcattaataacagaccctgggatgcggtgtaggtggtggtcagcgcacctgcagataaggatccgtgaacagcacctgctgcacctgcctcagactgcatctctgtaatctgtactgtatgaccgaagatattggttcttccgtcggttgcccattcatctgaagcttccgccataggtgaggatggggtaatcggatagatagccgctacatcagtaaatgcataagatgcatgtgctgctgcgtggtttccatccatggttttcatttttcttgccattttgatttcctcctacaaatgtgaatattgtatagtttggttccccgaagggatagtgacctgtttactattataacaattatttaacaaattgcaaataagaaaaatggaaaattacgtactattttaggaacaattccgcgaaacaccgggaactgcccgctgcaggcggccgcctgtcgtttttagggcagaaaaaggaccggataaaaattttatccggtccataaatcgtcctttagctcagcgggctcggcggaactacgttctgccccgagctgtttccgcccggcccctccggctgtaccgcctgggtcgtggttggctgggctgccgatgtcggctgctctcccggtccctgtccgggtaccgtatcgggctgtgccgtagtcggctgggtcggcgctgtcgtcgccggagtatccgtcccgccggaaggtgatgtctctccctccgaggtggcgatggtgctgcctcctgaagacgactcatccgtggcaggaactaccacgcctgatgtgttgcgcttgattgtcgcgggcttgccgcggtatgtgctgttgtggaagaactcgtcgcttaccacgacgccgtcctttttcgtcaccatgttcgtcacccagcggcttccctttgtctccgccttgacgatcttctcttctcccggctgaagggtctggtcctcttcgtaaaccggcgccggagcatccagttccgccgtcttcttggaggtcatggaaagtgtaactcccttttccagaatcgggattcccacaacggaaatcttcagctgccggtctgcaaagctggctctgagggcaattgccgtcgaagaggtgttaataaatttcatatcgggtccgccgaagcttaccatggcgtcctcacccggcgttacgtaagagggctcatagctgtgcgcatggcgctctgtcgtcgtaagaccggagaaaatgactgcgttgtagagtgtggaggaaacctggcatacgccgccgcccggctcttccaccagttcgccgtttacataggcaccggccggccggtaccccttggcctcggaacgctctcccgtggccttattgaaagaaaattcctcgcccggctgtaagatcaggccgttaagcgcttcggcagccagttcgatgttcttgtttctgtccttgttggccgtggtcgtggtgctataggttccaatcacctgatacagctccttggcctgtgcctccgtgatctccggagccgtctccttgccggtggcttcaatcacagcgctgaaatttttatcctttaactgagccagaatatcggaaaccagcttctcctggtcgatcaccagaccgttctgctctcccgagtagataaacttccctgcttccttgtcgaaaccggatacggaaccgttcttggccttcacgtcccactttgcggcggcctttttggcctcttccgcggccgcttcgtccagtccgttcatatccagggtatagctttccttcggttcgcccgtatagatatctcctaaaagggaatccaccttcgtctccagtaaatcggtgacctcatacgtatcatccttatacgtaatcttcatgccccactcatacttgtccagaatcgccttttttgcctgttctctggacattccggtgatggagatcccatctacagaaacttccttctgaagctccggctccggctggctcgtcgtctcgcccgtctccacctcggcaggcctgcttcctacgaacttcactgccgccataatcacgatcacggcaaccaccgcgataatgatccccagcagaatcttcgtgatatcatactgcggacgcttcttccgctttgaaccccttcccgaaccgccccgcggctggtaggaactcttatatcttgaggactggcccctgcttccctggcttgtctttctggaagctcccgttcctgtcttccgtgttccctgagaggaataagatcttgatgttccactctgtctgttgcctgtctgactcatctatttcaccttttcacatgatagtgtatattacattgagtagtataccatactttgtgggaaatgctattacaaatttatgaattttcttaattatttttcgtcgtttttctacattttacagaacgtaaaaaacatgttactatagtattactaaagtatttcaaattggaggtaattatggaactcatcgatctgcacgttcattctaacgcctcggatggcacgctcaccccggccgccgtcgtcgctctcgcagtggaaaaagaactgaccgccatcgctctgaccgaccacgacaccatcgccggcatcccgcaggccatagaggccgcccgcggccttcccatcgaaatcattcccggcatcgagctctcctgccactacgagggggaagagatccacgttctgggactgtatgtaaatccggacgatcccgcatttctccgggaaaccgaccgtctcctcatactccgcgagaaacgcaacgacgagatgatccgccgtttttcggaggacggcatggtactgaccagggaagagctcaccgccggcaatcccgatacggtcattacgagggcccatttcgcccgcgtcctgatggaaaaaggatatgtctcctccatggaccaggcatttaaaaagtatttaaaatacggcggccgctggtgtccaaagaaagagaccatcgagccctcctacgcgctccggatcctgaccgactgcggagcgtctccggtcctcgcccatccgtaccagtaccatctcggcgatgcaaggctggaagcactggtcgcttccttaaaagaagacggactggccggcctggaagtctatcactcgtccaacaatcagtacgaaagcgggaagctcaagaaactggccgtcaaatacggtctgttccccaccggcggctccgactttcacggggccaacaagccggatatcgacatcggatgcggccgcggcaatctgcgcatctccgcactgcttctggacgacatcaagcaggcgcgggccaagaacataaattcaagaatataaatatagagaggatttttattatggaagaattatacagaaccatcgaagaaacgatcaaaacctccggctgcccgttccctgccgacggagaagagatttacaatgaaatctgcgacgagatcgaaaacagggaaccgggtgcctacgtctttttctctaagaagacggatgatacattttttgaatacagacttcagatttttgaggacaactttaacttaagcagcatcgatatccatatcgcggacaagaactaccacattgattttgattaatttgtcgaatctgctgctgcctgatctgctgccacctgatctactgccgcctgatccgcggtgctgagccctgacagccataagtccgtcagggagtatcgtatctccccctgatagccgactgttgtcgacgccatggccagcgaatttaatactgcttcttccacagcttccgccgcggccgtaaaggccgtgtccaggaggctttcttttaagatccggatggtcaggatctccggatccctctcttccgaaatccggtttgccgtcgtaaaaccgatcattatgtcgccgctcccgtgtcccatgaaggatccggtccggctgagccctactccggctctcttaatcacccgttttagctgccggtcggaaagcggcaaatctgtcgcaatcacagtcatgatggatccccggtccagcaaagccggcttcgtcttcttctccagttctcttcccaccatctccccgcagatcattaaattcttcgtgcttccaaaattcgactgcaccagcgcgccgaccgtatacgtctttcctccgagcggaaactgcctggacgcggaaccgataccgccctttaagccgaaacagacggttcccgttcctgcgccgacagcgccctcttcaaaatcccttttcgcctcccggaccgccgtccgaacctcctctaaaccgatgatccgctcttttatcagatttaagccggaatcgttgcactctcccaccaccggattgatggtggtgacctggattccctccctctcacactgctccgacatcatgtcgaccaccgcgtcatgcaccttgcccacattgagtgtattggtcaacgcgataaatgtctctaacgtccccagctcttccatctgaaccagcccctggctctttccgaagccgttgtggatgtaggcggctgctgtcagcttgtttttataggggttgtcttcacacggcagaatcaccgtgactcctgtcttgtgctccgccgtattcacggtggcatggcccaccgtcacgcctgcaacatcggtaatcttattgaggggtcccggctccatttcgcccggaataatcccgtatgcgcggattcttttcatcactctttcctttccaatgcgtattttctgttcttattatacataaaagtgaccggctgaccggcattttcggaattttttcaccttgtatcccggaaaaaacgttgttataatctagacgtaggaaatggtaaagctacatagaattcccaaaggaggaatcatcatgaaaattcagaacatctctgacgtagaaaaatttttccaggttatcgaccagtgcaaggggaccatcgaactcgtatccgcagaaggtgaccgtattaatttaaagtccaaattaagccagtacctctccatggcatccatcttttccaacggctatatcaatgagctggaactggtagcccatgagccggaagacgtagagcgcctgatcaagtacatgtatcagggtgaataaaaacctggccggcatatgaaaatcccgccggataaagcagccggaagcagaccgattttatcgttctgcttccggctttttatcattttgcgcgtccgggctccggctccggctgcgccttcgcctttccacggttctttttctgctcctggtttttcgtttccagtctcgcgtaaaccattccgcggagcagagaatacaggacggaacagagcggaataaagatcagcatgccggcgattcccatggcgctgccgccgatggtaaccgcaacgagaacccagatggacggaagtcccaccgagttgcccaccacatggggatagattaagtttccttcgatctgctgaaggatgaagaacaccgccacaaacagaagtgcatcgagcggcttcaccatcagcatcaggaacgctccgatcacgcagccgataaacgctccaaatatgggaatcagcgcggtaaacgcgatcagcactccgactaacagcgcatagggcagccgcagaacggacagtgtgatgaagaacatggttcccagaatcactgcctcgaagcactgaccggtcaggaaatgggaaaatgtattgtatgccagatctgcaactgacaaaatattttccgtgatccggtccggcagaaacgcccgcatcagcttcttcatctgagccgaaagcgtctccttctgaagcagaatatagatcgcgaataccagggcgattccaaaggtagtcacgccgctgacgatggagaccgccgccgtaattgttgaattcagcacggtgctggctcctgaggagaggaatccgatcacatcctcggagaaggatttccagtcaatctggataccattgatataatccaggatttccggattctgggcgaataagtcttccgcccccttcttcacccctgccaggaaaaccggtatactgttctgcagactcataaatgtctcgaacagctgtggcatgacgacgaaaatgactaaaagcagcaggcctaccacaaacagcagggtaagaaccaggccgatcggacggcgcagtctgttgttttccttcatgggaagcaatttctcaatcctgcgcatggggacgtttaagataaacgccatgactccgcccagtaaaaacggtgagatgaacccgaaaatcatcataaacaccgcaaaaacacgccggtagttcacgccgatcaccacgaccgccacggtaaatacgataagccatcgcagcttctttatgttgctgtcatttaattccataaatttactcctttacctactacaatatatttatggttaatattccttacagccagtaaggacttatccatcttgttgcttaagctgttataatgatggagcaatcggtatatcggcttcctttcctggactttgcgtccgtaaaaacagactgataaccagctcctcattcgcagcgttcgttttatgcaggttgaactgcctccggtacgttcgtgtcacaccacagtagatggaataggcaatgagttaaactggtacttatccattgcagtaatcttaaggagtaacaagtttatgaatatgaacgcagtaggtattgatgtttccaaaggcaagagcatggttgctattcttcgcccttatggcgagattgtttcttcaccgtttgaaatcaaacatacatcttctaacatccagtctctgattgaacggattaaatctatcgaaggtaactcccgcatcgttatggagcatactggccgttattacgaaccacttgcccgtcagctttctctcgctggcctttttgtgactgctgtaaatcctaagctcattaaagatttcggaaataattctctccgtaaagtaaaatcggataaagctgatgctgtaaaaatagcccgttatacacttgacaactggattgatttgaaacagtatagtcttatggacgaactacgcaatcaattaaagactatgaaccgtcagtttgggttctatatgaaacacaaaacagctatgaagaataacctcatcggtatcctcgatcagacttacccaggtgtaaatactttctttgatagccctgcccgtgaggacggcagccagaagtgggttgattttgccactacatactggcatgtggactgtgtccgtaaactgtcattaaacgcatttgtcggccattatcagaaatggtgcaaacgcaggatgtacaacttcagcaaagacaaggctgaagaaatctatggagctgccaaagagcttgttcctgtacttccgaaagatgatttaaccaagctgattgtgaaacaggccatagaacaattaaacactgcttctaagaccgtggaagaactccgtaccctgatgaatgaaactgcctctaagctgcctgaatatcccgttgtcatggaaatgaaaggcgttggcccatcacttggccctcagcttatggctgaaatcggagatgttacacgctttacccataaaggagctatcaccgcatttgccggtgtggatccaggcgtaaatgaatcaggaacttatgaacagaaaagcgttccaatttccaagcgaggctcatcttcccttagaaagactttgttccaggtcatggactgtctcgtcaaaacaaagccgcaggatgaccctgtatatgcgtttattgacaagaaacgggctcagggaaaaccttactatgtctacatgaccgcaggtgctaataagtttctgcgtatctattacggaagagtaaaagaatatcttatgtctcttccagaataaagaatgccacaacctttcagaccagcggataacggtggtctatttgttgtacttgaaatttcatcaacaataactcttaaaaacttttcattatactattgactttttatttgcaggctgttctgtaaatgtttccagaatctcctgtttcgctgcctgaaaggtgccctgggccatcagggagcttccgccgccttttccgtttaattctttgtttaagtatttgctcagttcccgcatgtcaaaactgctgcttcctgccgcatactggtagctgccttccgtaccggagcagaccaggaccacgcttcctctgccgccctcatagagcatggtgcagtactggcgaagctgaatcggcgccagcccctcctcgaataccgccagaggcttttggctgggctcaagctgttccattctggccgcaaacagttcctgatacagctggttgatcttcccatccttcataccgctttcactctttaacttctccacggtttccgtgactttctccggcttggctgaaagcagcacggacagctccgtcaccgtcttctgtttcttctggtaatccttaagggcgtccataccgcagagcatggaaacccggataccgcctttgtagtgaatcatgccggtgatcttaaagatgccgatctctccggtggtcatgacatgggtgccgcagcatgcgcagacatcgccgtccggaatctcgatgatccgcaccggtccggtcagctccttcttgcttctgtactccatggcgtccagctccccggcggttggatacagctccagaaccggcagattctctgcgattttccggttgacctcattttctaccgcctccagctcttccgccgtgagcactccgttaaagtcaacggtcacctcttcgcttcccatatgaaatcccacattatcgaacccatactttttatgtaccagtcccgaaaatatatgttctcccgaatggttctgcatgtatccgaaccgtctctcccaatcgatggtacctgtaacggctgtccctgcctctaagggtccgtcggtctcgtgaataatctcccccgccttttcaaggacatccagtaccttcacagatcccaggcttccggtatctccgggctgaccgccgccctccggatagaagcctgtccggtccagagtcacctggaatctgccgttcttccccggccggcagtctgtcaccaccgcctcgaacgattttacatagggccgtctataatataatttctccatataatctacctcttttcccgtttgtaactaattatacacaagtattggataagttcaatcatatgaattctaaaattttacgaaaaatgtggaaacagtggcaagcagggtcacatacatttaagtgtaaacaatttatttggaggaacaaatatgagtgatctggcagcaacaaattgtggatgtggttgtggttgtgaatgcaacaatggaggaagtggatgcaactttatctggttgatcctgattctgtgctgctgcggcggcggcggtttcggaggcggcagctgtggctgcggcggtggttgtggcggcggctgcggtagcagcaacggatgtgatttcatctggatcatccttcttctgtgctgctgcggaggcggcggcggtggtggattctgctgctaatacatgcagagaaaacatttccacgaaacataaagactgcggtccggatattccgggccgcagttttttggtgtaacagggcaatttcctgttacaccaaaatccctccgggcaggacgcgcactccgggcaggcggcggtatatcaccgcctctgattcttctcctgccccggcgcggccagcggattttctccatttcccccgcggccggaatttctgccctgttttctctttacgcactcgtcgtcaatttcatatactgcattgccatctataattaaacgatttctcatgtttatcactctcctgtaatactaatatatgcggccgcatatattgtcaacaagaaaagtaaggatatcatgttatgaacaacgaaaaaaattcccagccagttgacctggattccttaatcggtgataaccatttacagatgatgaaggccgcccttccctatatgagcgtgaccgagcagcgttttatctctctctttgtcaaattcaatgagcttcgccgcaccgtaaagctgtttgaggacgaggaggtggctgccatgggcatctgctccacaggagaagacaccgagaagccggcttcccccatcgatatgctgggcgccatcaaaccgtttgctacaccgacagaacaggatctaatcgatctgatcatgaactttttccagggctttaagctggcaggagcagtatccgacgcggttcccgggtccatggtaccggatcccgagcccactgaaaatacggccaggcaggcacagtcacagacaccgcctcctcaccgctccggcggaccgttcggacgcatgtccttcgatcagatcaagaactttattcctcaggagcagcagtcccgtctggagaccatgcagctcatgatgtctgccatgcagcagatgaactaattcaccgctacatacaaagaaaggaagtttaccgccctatgaataccaactggaaacaggatccccgcttaaaaggcatgaaccaacagaaacttgagctgctgactacattcgcccaggaggtagaatccgcgccgaaggaacagctgatgtccacgatcctcactctcaatttaaaggccaatgaaaaaggcatccatttttccgatcaggagacggagctgctcgtctcgatcttaagcgggggaatgagccccgccgaacggaaacgcatggataccttacgcatgatttctaaaaatttgtcaaaacggaaataagactcacgccattactcctgctccaactggctgatatcggaaacaatgacaatcctggtctcttcatcgacgctcgtcaccagctttttcatgtactcctcggacaccttgacacagcccgaggttccgatgtcagccgctccattcatgcagtgcagaaagatggcggaacccttcccaggcacgcggtcactgttgtagtcgagcgccagtccatagttgtagaacggaaccatggcggccatatgctccgccgacttccagtctttttttgtgctgctggaatccaccagctggttataatggctgctgccaggatcatccacccagtaatcggtatccgtcagctggtgatacggcagaatactgcccggattttccttcacgccaaaggccatggtaaaacggtacgttccgaggggagtcttcttatccccttccttcttatcgcccgtcgctccgttctttccatatctccccgcagtcacaaattcttccgtccagatgcccttatcatccttcgtatgataggaaaggctgatatccgcctccccctgtcccaccacaaggatcagactgtccgtttccgaggcggccggtatatttcccataagttcctgctccttagcagactcctctgtgttgatatccttcaggccgattccaggacctgtctcctcttttccgtttatcccatccacggcctgtccagccaaacgtccatctgtctgaccgtatacagccgttccggcggcgccgacgtacgcaaaaaggaccgcccctgttatgaccagcaaatatttctgatatcgtctcattcgtaaattcctccgattatcatatcttatgctgtcattatacacggtacggtcccttttgtcatgcctgaacggctattttaatcttacaacatgctgacaatatatgtacacattcttaatttttttagcctgctctccttcttcccccaaaatgatcggctgtgtgccggatggtgtaatgtacagtttaaatgcaattccatcctgacctaccttcatctgcctgaccggacggtactcgaacgtcctgcgctcgattcccagatattcgtaaatggcattctccaaatccttgtcttcaaagcatttagcaatatcctcttccgcattcatatccagaatagctttcgcttcatcaaacgtcagatttgcaaaccggaaatccccgtctcccagtatataggccagagtctcattatcaagaagcaacaatgggtaacctacgctcgactgctccataaaatacctccttatctccgtttattataacaaatttctcaattatctgctattactattatcatatctatttttctttcatttgtcaatattttctgattcttttgtatttgttcgttaattatcaaactattgtgtttgatttattctcacagcaggagtcaaagcaagaatcacaacaaaagacacccttcggctgccgcctccgggtgtctgtaactgctatttgcaaacaatattgataattcttccaggcacatagatttccttgacaatcgtcccagtcaatttgtccgtaaccagcgccttgccggcctcgatcgcatcctctttggctgtaccggccggaagcgttacgaccgctttcgtctttccattcacctgcacggccacggaaatctcatcttccttcatggcttcctcatcgcataccggccactgggcatggaataccgtatcgcttcctcccagctgctgccacaattcctctccgatatgaggcgcgaacggtgcaagcagaataacaaaggtgcggagcgtctccctgtcgattcctccggtcttcttcgccagctcgatgaatttgttgttatactccataaatccggagattaccgtatttaaattgaactggttaaaccgctgttcgatatcaaagatcagcttattgcggagacgcaccatctctctcgtcggttcggtctccttatccttgctgtccatgacgagattccagagacggtttaagaaacggctgacgccttcgatccctctgtcgtcccattccgcgtccagctccggcggaccgacgaagagttcgtacattctcagggaatcacagccgtaatcacggaccagttcatccggagataccacatttcccttggatttgctcatcttgataccgttcttgccggtgatcatgccctggttaaacagctttgtaaacggttcgtcaaaatcgatgacgccgatatcacagaggaatttcgtgtagaacctggagtagagcagatgaagcaccgcgtgctccacgcctccaatatacatatcgacaggaagatatttatccgccttttcgcgggaaacaagctccttctcgttatggctgtccacataacgcaggaagtaccaggaggaaccggcccactgcggcatggtgttcgtctcccgcctggccggagcgccgcagaccggacaggtggtgttcacccactcgtcgatggcagccagcggagattctcccgttcccgtcggctgatagctttccacctccggcagagttaagggaagctgatcctccggaaccgggacattgccgcagtgcggacagtggataatcggaatcggttcgccccagtagcgctgtctcgaaaatacccagtcgcgcagcttgtaattgaccgtcttcttaccgattccgcgctcttcaatcatcacgggggcttccttctttaagacggaagactccattccgttccactcgccggaattgatcataattccgctcgcctcggtataggcctgtgtcatatgtccgatctccactccgtctttcgcaataacctgaataatcggaagatcgaatttctttgcaaactcaaagtctctgtcgtcgtgagccggcacgcacatgatggctcccgtgccgtaatcggccagcacatagtcggagagccagatcggcacctttgcaccatttaacgggttgacggcgtagctgcccgtaaatacacccgttttttccttatcctgaagacggtccacattcgacttcatggaggcttcatagatatacttctctaccgcctccttcgtctccggcacggcgagaccggccgccagctcatgctccggggccagtaccatgaaggtcgcgccgtacagcgtatccggtctggtcgtatagactttaatcgcttcttcccgtccgtccactttgaaatccacttctgcgccgtaggacttgccgatccactctgtctgcatcttcttgaccttctccggccagtccagcttatccaggtcatccagcagccggtccgcgtaggcggtaatctttaacatccactgccttaagtttttcttcgtaaccggtgtctggcagcgttcacagcagccgttcaccacctcttcgttggcaaggcctgtcttacaggaggggcaccagttaatcgggaattccttctcataggccagccccttcttaaacatctgtacgaagatccactgcgtccatttatagaatccggggtcggtcgtgttgacctccatatcccagtcatataccgcggcgatctcattgatctgacgcttgatgttggctacattctcagccgtggatttggccggatgaacgcccatcttgatcgcatagttttccgccggaaggccaaaggcatcccagcccatcggatggatgacgtagtgtccctttaaaatctgatacctgctccagacgtcggagatcacatatcccctccagtgtcccacatgaagtccgctccccgacggatacggaaacatatcgagacagtaatacttcggtttcttcccgtcattgatatttacgggattctttttccagttttcgcgccacttcttttcaattgcgctgtgattgtatgatgatgccataacaaaccattctccttcctgataaaaaataaaatccggctccctggaattccgcaaaatacagagtccggcgagcaggactctcgcgccggagcgcggccgcttcagcggccatacttccttagcgcggagtgcccagcctcccggagttttttttatttcataggacaaactttccaatgaaataaaaaacgcgtctccaccgtccaggccgttcaggccataacgatagagacgcggattccttccacgcggtaccactctatttcatacagaagctgtatgcacttatcggatacgcattcatatccttcccccgataacggctgggatgccggccgcacctacacaaaagcagcgcttccttcagtgagcaactccaaggcgagttcagccatccttcccaaccggctcgcaccatacgccgactctctgcatgttccagaccgcttactgttcctcttcacagtatttatgctaactatgaatgtatcacacttgtcggaacgtgtcaaccgctatttatcatttccctgcaactcccactcccgcttaggaaaacagaaacagtcccacggagacaaagaaaaagaggatcatgcccagatttaaaaacagggtctcgaaccgccttcctctcgggatcgccagcatcgcgggttttaagcggatctcacggcggtaaagaatcaggaatacgactcccagtacaacggccgcaatcatgaagatgccataggccatggcaaaccagatattatccgctgcacgaagcgctacgatcgatcccataaaattaatcaccgcatggaatattatggtataacgaatctttcccgtgttgatgtagacgtatgcaaacacgacgcccagcccaaaggcatagaaaaactgatagaaattcccatggctcagcccgaataagactcccgacagaatgatagccacccggtcgccgtaatgagccacccggtcgatcagcagcttccggtacagaagctcctcaaatatgggagcggccaccaccgtcaacaggaaaattacccacgtatccagattctcgatcagctcgtttaccggatttaagagaggcttgccctggattccattcacgatgctcatgaggacggttcctataatatttccgatgtacataatgctgatgcaggcaaaaaaagcaaccaccagccgcccagcgccgaacggctgcctctgcggcctgcacggtgttctcatgtctttcacaatgagccagcatatcagcgttccgaacaaatacatgggaatcgagcccatgagcacgatccacgtattccagtcccccttccaccccattttttcaagaactccgagtatcagccccgcctccgcctgtaccataagtcccaccagcagaaaggccgcgtatcccactccgagccttgaacacgttttctttatttctcttaagtaatccatccggtcactacctcctgactcttcttaccatcacgtttccaagtttatcacatctgtctcatgttgacaagaaatctcaggggaaaggagaaaacctgcgcaggccgggaacgaaaatgaggcggaacgatcttccgttccgcctctcattatctttattctttttcttatgcctcggttctgtcaaccttggaggcacgctcttccacttcacgcttctgaacatcgccaggagcctgctcgtagcggctgaactcatattcatacgttcccataccgcctgtcatggagcggaggtctgtattgtatccaaacagctcagacatcggaacatcggcttcgatgatctgcttgccgttatggttggaattcatacccagtacacggccgcgtctgcggtttaagtcacccataacatcaccggtgaacttatccggaacagtaacctttaaggaggcaatcggctctaacagaaccgggttcgcttccataaagcccttcttaaacgccagggtggccgccatcttaaacgccatctcggaggagtctaccgggtggtaggaaccgtctgtcagcgtcgccttcagtccgacaaccggataggctgcgagaggtcctcttaagatacactctgcaacacccttttcaacagccgggaagtagttcttcggaacagcgccgccgaatacagtctcctcgaatacgtaaggtgtctctaaatcgccggatggctcaaaggtcatcttaacgtcgccgaactgtccatgtccgcctgactgcttcttataccttccctgaacctcaactttctttctgatggtctcacggaacgcaaatttcggtttgcttaactcgatctctactttatagcggtttaacagcttgctgactacaacgtccagctgctgatcaccgattccgtataacagggactgatggttctctgtatcggtaactgcctttaaggtccagtcttcttctgtcagcttcgacaatgcgctggataccttgtcatcatcgccctttgtcttcggtttgtaacgcatatacgtatacggcgtggaaatctccggcttatggtatacgatcggcgcggaacggagcgcaatggtatctcccgtctgggttacggataacttggatacggcgccgatatcgccggccttcaattccggaacctcgatcacgtcttttcctctgagcagatagatctttccgatcttctcctctgtatccttgtttacgttatagatattggaatccggttttaaggtaccggtacaaatcttcatcagagagtatttgccgataaacgggtccacaatcgtcttaaatacacgggcggaaagtgatacgttatcgttatatttggctgtaaagcgctctcctgtggatacgtccacaccgatacactcataacggtccggagtcgggaagtacttgtcgattccctgaagcaccatcttcgcaccctgtgcgttaatgccggagcccagcataaccggtacgatattaccttctattacatgttcccgaagtgcagaagagatctcttcctgagtgaactcatcgcctgagaagtagcgttccatatactcttcgctcgtctccgcaacagcctccatcagcgcttcacgcgcaatccccaggttcttctgtgaatattcaggaatctcacattcttcatagtcactgttcaccgtgaatctgcggcccgccatctttacgacgttgacaaatcccacgaacttttcattctcacgaatcggaagatggaacggtgcaatctttctgccgaactctttttccagtctcagcagcagttcacggtagcttgcatgatcgtcatccatattcgttacaaaaataatacgcggcagcttatacttttcacaaagttcccatgccttatatgtaccaacctctatgcctgccttgcagttcactacgataaccgcggcgtctgcaacgctgattgcttcttctacttcaccaacaaaatcgaaataacccggcgtatccagcaagttaatcttgatcggaccgtcttcaccctgatactccagcggaatcagagttgtggaaatggagaactgtctcttaatctcttccttatcataatcgctgatggtgtttccatcggtgatctttcccattctgctgacagctcctgtaatcagtgccatcgcctctgcgagtgtcgtcttacccgcgcctccgtggccgagtaatacaacgttacggatttgtttggttccatacacgttcataaacattcctcctgttcagtatttaagtctatgaggatattttactaaaagtgtcggaaaattgcaagtagaatgtgcattttgcacaaataattttacttgtcaaaatatgggtttcctacagggccggacaccaggcggcctggggtctgctttctcctttaaaatcaaggaaagacgcgtgatacggggcttcattctgctccgcttcgttggctctgttccatatctttaaggcggcctgcagagtgatctccacatcatgatagtaatagataccggcctgagtatgagaaaccacgtcctcaatcaatagcctggcatcctggttttcaaacagaacttcatttaaattattcctcgtcagcttcatagtattgatcttctccttcctgtcaggttctcacatttcgaacatacgttcttttactatattcattatatcagaacatacgttctttgtcaaatcttttcgcatcgtctttgctaattcgcgttaaagcgtcgaagtttaacgtataaaagcgttgacaacttacattctttcgattacaatggtgcttaagctatttttgaatacttgttaaagagaggaaaccgatatgattattattatgaaaccgaacgcttccgaagaagcggttgggaaaattaaaaacctgatagaatccaaaggcctccaggctcatctttccaaaggaacggaggtcaccatcgtaggcgttgtcggcgacaagacgaagctccagggcgccaacatcgagatggcggagggcgtggataagatcgttccggtcaccgagacgtataagctggtaaacaaaaagtttcacccggaggactccgtgatcgaggtcggaaataccaaaatcggacctggcaggctgaccatgatggccggcccctgcgccatcgaaaatcacgacatggtcatcgagacagcgatcgccgtaaagaaagccggcgcagaatttttaagaggcggcgcctacaagccgagaacttccccctacgccttccagggactggaggaagaaggcttacagtatatgaaggaagcccgggatgagaccggccttaatattgtctgcgaggtcaccagcttacgggctctggagaccgcggtgaagtacgtggacatgatccagatcggcgcccgcaacatgcagaattttgagctgttaaaggaggccggacgcgccggtatcccggtactgttaaagaggggcttatccgcaaccatagacgaatggctgaacgcggcggaatacatcgcctccgaaggcaatccccgcatcgtactctgtgagcgcggcatccgcacctacgaaaccgccaccaggaacacgctggacatcagcgccgtgccggttatccgcgccaagagccatctgcctattctcatcgatccgagccacgcaaccggtgtccgcgcctacattgagccgatctccaaagccgcagtcgcagtaggcgccgacggtctgatcgtggaggttcacccgtgcccgtcctgcgcgctgtccgacggcccgcagtcgctcacctttgaacagtttgagcagcttaccgaaaacctgaaaccttacgcaacgcttgcagggaggatattttaatgactgattccaccattgcctttattgggcttggtctcatcggcggttccatagccagagggatcaagcgtgaaaaaccggatacgaagattatggcatacatgcggacccgttccaggctcttaagcgccctggatgagggcgtgatcgacgtgatactcgacggagtcaatgaacagttatccgagtgtgatctcatctttctgtgcacccccgtggaatataacgcccgctaccttgccgaaatcaaaccatttttaaagccgggcgccatcatcaccgacgtggggagtaccaagaccgacatccacgaggcggtcacccggctcgggatggaggactgctttatcggaggccatcccatggccggatccgaaaagacaggcttcgagaattccacggatcatctgctggaaaacgcctactacatcattacccccacccgcagctcttcccctgaggcggtggatcggctgatatccgtcgcttcgctgatcgggtccatccccatcgtcctggactatcacgagcacgattccgtcacggcagcgatcagccatctgccacacgtcatcgcctccagcctggtgaatctggtcagggatgccgataatccggatggtctgatgaaacgactggccgccggcggctttaaggatattacccgaatcgcctcctcgtctcccgagatgtgggagcagatctgcatgacaaaccgggcgcctctggccgccgttctggagcagtatatcgcctccttaaacggaactctggaaaagctcaaagcgggtgacaaccagtatctctcccggctgttcgagacttccagggactaccggaactccatttccgagaggaaccagggctctgtcacaccagaatattcgtttaccgtagacatggcggacgaggtcggcgcgatctccacactgtccgttatcctagcagccaagggcatcagcattaagaacatcggcattaaccacaacagagagcacggggagggcacgctcaagattatcttctacgacaaggaaaccatggacatggcgtggaagcagttagagcgctaccattacgacctggtgcgtgtctgaaaattgacatacggaggaacaccatgaaatttaaaaaggcaagcccgcttaagggtgaagtacatattcccggcgataaatccatttcacacagaagcgtcatgttcggatcgattgcaaagggaacgacgcagatcagccattttcttcagggggcagactgtctttccaccatctcctgttttcagaagatgggcgtggccatcgaaaataacggcgattccgtcatcgtccgcggcaatgggctgcgaggcttaaaaaggccggataccgttctggactgcggcaacagcggcaccaccacccgcctgatatccggaatcctgtcggcacagaattttgacgtgacagtgaccggcgacgaatccatacagaaacgccccatgaaacgaatcatagagcctctttccctgatgggcgcccagattgagagcctccgtcaaaatggctgcgcgcccctgcatattacaggcaggccccttcaggccatccattaccattccaggataccgtccgcccaggtaaaatcggccatccttctggccggactctatgcggacggtgagacaagggtgacggaagactatgtgtcccgcaaccattcggagctcatgctccgctccttcggcgccgatgtgagatgcgagggcacgacagccatcatctggccggccggggaactctacggaaaacagattacggttcccggcgatatttcgtctgccgccccatttcttgctgcaggccttttggtgccgggttctgaactgctgatccgccaggtggggatcaatcccaccagagacggcattctccatgtctgccgggccatgggcgccggcataacgctgatgaatgaacaggatgcctccggggaacccaccgctgacattctggttaaaagcagcagcctccacggcacggtcatcgaaggagccatcatccccactctgatcgatgagcttcccatgatcgcggtgatggcctgcttcgcggaaggcaccaccatcatcaaagatgcggcggaattaaaagtcaaggaatccaaccgtctcgaagtcatggtaaagaacttatccgccatgggggccgatgtgaccgaaactgaggatggaatgatcattaacggcggcaaaccgctgcacggcgccgtgatcgacagcctgctggatcaccgcatcgccatgacttttgccgtcgcagggctctgcgcggaaggcgagacggagattcttggggcagaatgtgtgaacatctcctatcctggtttttatgaggatctcatgaagttaatgagataataatagtgccaccggcactagctgcggcagtattttcagttaaaacagtcaaacaaaaatgagcagagaagacgccatgctttccgtcttctctgctcacgtttctattctcttacaggactctgttcagaagttgtactccggttcaagaagcctgtccctggtactctttcaaaagcgttttcaccgcctcttccgcctccataaaccagacgtctccgggtgttacggacaggacaaatccgattttccctaacagggacatcagatacttcacctctccggcctctcccagatccagatatttcttctctgacctgctccttatatgctcccgcacgccaaatttccggcagtaataaatatcctgcctcagctctctccggtaggcggctggaaccgacaccctgtcgttgaccacaatgcctgtcaccgtctgtctggtatggcgggtaaggacctttgtctttgaccggttgagttcaaaacccatggcgtccagaaatcctttcaccttcccgatcacctccgccgccgcaaaatccccggaaaatgtcatgtcgtcacagtagcggctgtatacaatatcccgttcccggcaccacgcctccatgtattcgtcaaacggcttcatcaccagattcgatatggcggccgaggccggcgatccctggggaagcgtgtcccttaagcagcacagcgaggtcagaagcgtccctaccgggacaggaaaatacctgctgttaaatgccctctgctgcaccatggaaaatgtaatagttccgaaaaaatctttgatatccagcttcagcaccacatttttgcccgtatggcgggctgcattatcccggatggacgcgcctctgtggtaggccgccgcgcagggcgacagctccagcccctccagaatatggtgaaggatattccgctgtatcgtcttaagcagcgggtccggcgcctgaatctgccttacgcctccgcccttcttcggaatccgaagccggttataatgtttttctgtatgattgctcacggcatacaggcaggatatgaccttatcatcggtccactcctccccctccagaagccggaaggaaagaagcatctccctgcagtgctccgccgtgcagtatttccacaaatccggttcgtgcataggtagtccctcactctaaatgacatggcagctttcctgtctttcagccggctgcccggattcaaaagataaaacgacaggaaatcatacgaaaaaggatgccgtaagatgcgaagatgtacaagccgcaggcgtaagcacatgaaatgtgcggatgtacttcggagcagattacggtcttttgaccttaaaatattaacaatcctgacagcggctcgctgcccggccggatctcctttatggttccggaaaagctatgattccctgccgtcttatatttctttattctaacacacaatgagaccgcttgcaaccgtccgcctcccggccctgctgtaacgcgttacgattctgcgactgcctttttcagcatcacgaaatagaggataatcccgacacccgtcataatatggccgaggccggcgattccagatatggatgcatccatggcacggctcagctctaaggcgcgcacctggacaatgcccctgatgatcagcatcaccaccgttacggcgatgcctgcattatagattccaaagaacagcccaaaccgcttctgctccgtcaccgccgcatgaaactcaaacagcgcggccacaaggaaaacgatcattcccagcaggaataagtgagtgtgcacgaaggccagcgtcgttcttccggaaaagccgttaaacttcgtgaattcacggtagaatacacctcccgccatggccagcagcgcatagaccaacgcggtgtttaccagctttaatactgctttcttttttctgtcatttgtcatattacttctcctttctctgtcccggctgtttcatctcccggtatcccatgaccacgatccacacgtaagcgcaggtcttggggatcataagcgcgcccaccgccgggatggtatccgcccacagcacaaccggaatatagaatccaaagctgagcgtaatcgccagccacataaagccaaagcccgaatccgccgtctcctttgccttccggtaaaagaggacaatcatcagaagtcccagaaccgcaaacggaatattgcggtaaatcccccaggaaagcggtgcgctggcgcttaaccagtcattgcccggcatgaagcacaggaatactctcacaagggccagcccccatacgacggcagtcagaccgttctttccctccacgcggtaccgcatcttccatatgtagtacagaatcacataaaatacggtcatcgtcacagaggttaccagctttccaaatccaagggccgcggcgtgattcgccagcccatccgtacagagggcgtaagcgcggggcactaagtgaaatgcgtcaccgcatcccagaaccactgccatgattccaaacagcttaatctgctttctctctcccgctccggtgatcatacgcactcccagcgcaatcaccgtacataaatatacaatgtcaaagattgtttccattactgcctgcatcgtcatacttcctttcctgtgtctgcatctgtcttatagatcagacgcctcataatctcttcaaaataagccggatcttcctgattcttcagaagaagaaccatgttggagaaggcaaaggatacgaacctttcgggtgtaaatgtctcgttccagacctccggtgccaccctgttgtcgcgctccagaatacggagcatcccttccttcatatgtcctaagtaaaatgcctccagctctctccctctcttctgatcggtctggctgagcacctccatctcctttaaaaactcctcgcggaagcttcccaggttttcgcgcaggcggaaatggatatcgtggacacttccgataaaatcaccgctctctgtgtcaaaatgactgccatgaaacacattacgccagaaatcctccataaccgccccgattaaatcccctttggaagggtaataattgtagaccgtaccgatcgcgataccgctctctgaggccagacggcgtatattcagatttccaattccctctctgcccgcgatctctttcgcaatcgcaagcagctcttcttttgaagttgctgatttcttcatatggacctccttcaatatgaacattgttcattatactctgtaacagccattttgtcaaacagttctgtcgtattttttcttgacatcccgtctcctttcggatagaatgtaatgaaagtaagtacttgcatggaggtggaatacatggatgataccagccagagaatcgtggacgcagccatggagctgatccgcgacaaagggtatgtcgccactaccacaaaagacattgcaaagcaggcaggcgtcaacgagtgcacgctcttccgcaaatttgcaggaaagaaggacatcgtgctggccggcattgaccaggaaaagtggagggcggacgtcacccccctggcctttgaaaacgtcacgtgggacttgagaagcgatttagagatgttcatgaacgcgtacatggaccggataaccccggatttcgtcaacctctccatcggcctgcgcgcgccccagatctacgaggaaacggccccgttcatcatgatgattccaagggccttcgtctcctctctcatccggtattttgaacagatggaggagaaggggaagctgaatcacggaagctatgaatcatgggccatgacgattttctccgcgaccttcggttacacatttctgaaagcgtctttcgacgacagcctgtccaaaatctcacgtcacgattacgtcagagacagcgtcagggtctttctggaaggaatcggcaggtgggaaaatcacgaacagtgaagaatcatgcacggtaccgccgtaaaaccgcggtaccaattttatcccgcgcatgacagcaagtacttgcattcatataatatttaagaaggaggcagtgattatgcaaatcacaggcgcacagctttttgtaaaagcactgaaggaagaaggtgtcgaagtcctgttcggctatcccggcgggcaggccattgacttatttgacgctcttcacggggagaccggcatccgtttcattctcccccgccacgaacagggactggttcacgccgccgacggctacgcccgctccaccggcagacccggagtctgtctcgtaaccagcggccctggcgcggccaatttagtgacaggcatcgcaacggccaattacgacagcgttcctctcgtctgttttaccggccaggttcccaccagcctgatcggcaacgacgccttccaggaggtcgacatcacgggcatcaccagaagcatctgtaaatacgcggtaaccgtccggacaagggagagtctgggggaaatcatcaaaaaggcgttccatatcgccacgaccggaaggcccggccctgtgctggtggatttgcccaaggatatacagagggaatacggcagcagctgctatcccgaccaggtaaaaatccggggataccggccaggtttcgccgtacacggaggccagataaaaaaagcattagaacgcttaaatcaggcgaagcggccggtcttccttgtgggaggcggcgtcaatatcgcccgcgcggaagaagccatgacacggcttgccgagcgtaccggcgtgcccgttgtgaccaccatcatgggaaagggcgccatcccgtccacgcatccgctgtatgcgggcaatatcgggattcacggaagctttgccgccaattcggcggtcagcggctgcgacgtcctcttctccatcggcacccgcttcaatgaccgcatcaccggtaagaacggggagtttgccaggcatgcgtctatcatccacgtggacatcgatcccgcttccatttccagaaatatcgccgtcgatattcccatagtcgccgacgccggagccgccatccgggccctcctggaaaaagctgttttgctggacaccggcgcctggaggaagcagatcgatggctggaaagaagcccgtcccatcaccatgaagcgggagggactgacagcggaatccgtcatccggtccatcaaccgcctagagggcccgctcttcgtcgccacggatgtcggtcagaaccagctgtgggcaacccagtttctggagctgagcgaggaccggcgccttctgacctccggcgggctgggtaccatgggatacggcctccccgccgctctcggcgcgaaaatcgggaacccggataagacggtggtgctcatcacaggggacggcgggttacagatgaatatgcaggaactggccacagccgtggtctgcggacttcccgtgatcatctgcgtgcttaacaacggctggctgggcaatgtgcgccagtggcaggagatgtttttcgatcaccgctattccgctacctgcctgcgccggagaagcagctgccccgcggtctgtcaggagcccggaccgggctgtccgccgtacacgccggatttcatcaagctggctgaaagctttggaattacggggatcagggtaacgaaggaggaggagatccaaccggcccttcagaccgcagaagccagcaaggacgcgccggttctgatcgaatttctgattgcctgggatgacaatgtgctgcccatcgtaccgccgggcagtccgatcgaccacatgattctggaaaatgagagggggagataacgatgaaaaagcgttggatcaatctttacgtagaaaatgaacccggcgtcctggccttaattgccggcctcttctccggaaagtcctataatctggagagtctgaccgtgggaccggccgaggatgagacggtttcccgcatgactatcgggctgaccagcgacgaccagacctttgagcagataaaaaaacagctcgcccggcgtgtggaggtcatcaaggtcgtggaccttacggagaccgccatgcactgcgaggagctgatgttcttaagaattcatgactgttcggaggacgatatccgggagctgtttcgcatggcgtcagtctttcacgccagtgtcatcgactactccccgtcttccgttctgttgaaaagtgtgcggccggaggaggaaaacagccttctcatcagccggatgcagaaacgttttccgaaccggatcttttgcctccgcggaggcagcgtcgccataccggctctgagcccctcggattagtgcagctcttcactaacgctgaactgcttatacacagggccatgcgcccggctgcggacctctttttcctttttcggcgtccccttcttcctgatatggagggaggcgaccgccaggccgctgaccacgaggaagccatagaagctgatgccccggcttaacaccatgacggggagcagctgggatgagcttaagaagccgctgaacatcaccaggaagccgctctctgacgcccccaccgcaccgggcagggggacggccgacactgcaaggctcacgatagactgaagcataatgaagttgaccagacccacgctgcccaggccgagggccagacaggcacagtaggaggccatatacaggaaggtgagctggcagaaggtaagcaccgccgtcttcaccgcagccatcggatatttccgcagatatgcgccgccctggctgtactcttcgatcatggaaccggctttctgtgcggccttttccccatcaaaggaaggaaaatggttcaacaggcgaagaactctgtataccagccgctccacaagcggcctgcaaaacagaatcagcaggataaatgccacggaaatcccgtttgccagaatcccgaaacagatcaggagcttaagcgccagcggcagtcccatgagatacgaaaacttaagcagccccatacccacaccgtaagccagcgccatcagctgatacatggccgtaatcgtcagcagcgcgaacgagcttctcgccgcgctcatcccgtcgcggaccatgtagtacagctgcatgggctggccgcctgtggatgagggcgtgatcgagctgaaataaaagcctgcgaaggagtactgcatggctctcttccacggcacacttcctccccacgtccccgccaggagcctgatcacggctgcctcacagccgacaaacagaaccatgagaaaaagccccagcagcacaaagcgtaagtccgcgttctttaaaaccgcccacagggttcccatggaatggtccttcaacagtatgtaacacgtcactcccgccagcaccaccatggccgccgtgcagaggagtgaatttttccatttcatggttttctgctccaaatcgattcttcctttctttatctgaaatcacttatgtggcaatcatctatctgaatacagcttccgaaggaagtataaaccggcagcccgcctcttttagcgcggggatcacataagtaagcgcttccagcgtcttctccggagctccgggcgcgcctcccgtacgtcttcctccgtcgtgaaggcagaggatggatccgtcctttacacggctcagacacttcttccggatcgagcctgtcgtggctcccttctcccagtcctcggccatcacatcccacagaaccatcttcatcccgtattttctcacaaaatgccaggaaaacaggttcgtcagcccccagggcggacggtaccagatgtcggatatgccttttctcttcataaattcgcttccggtgcgaaaatcttttctcgtgtgcagatatcctctcaccatggcgttctggtggtccatggaatgaaagcccaccacatggccttcggacagcatgcggtcgatcagcgcttcctcttttaccgcctctctggtcaccacaaagaaagccgctttcacctcctccttctttaaaaggtcgaggagccgcccggtataatccggatcgggaccgtcgtcaaaggtgagcatcaccgtcccgggaactccggttcttcgcagcaccgccggatttctgtgtttatgatacaaggacggaatcacggaatgcactgcaaatccgccggccagcagtccaagagccgcggccagtctgctccatttccattttctgctccatttcatcctgtacataacgctccttccggtccttcgatcagggcgagtacctggccaatcacggtctggtcgtactctctcttcaaacggtctacatttgccttcatggcgtccagaagcgtatcatcctgaacgatcttgctgatctcccggacacagtccatggggtttttctccagtatcattccgataccgcggcccacgataaagcctgtgttgttgatctcctgctggagaaatggttcaaataccagaagcggcgttcctgcatgaatcgtctcaaacagggtgattccgcccggcttcgagatcaccacgtcggcctcctgcatatagcggtacacctcgttggtatatccgatcacatcgatattcttgtattttccatgaagcttcttgtagatttcctgattctttcccgtgatcaccgtaacccggatgtgaccggaatcgttcagttcctcatagaattcattgctctcaggcaggattccgagaccgccgcccatgatcaggatgtgcttcttcccatccgtctcttccggccgctcttccccgtaatcgaattccggtctgaccgggattccgtagacgtaaatcttcgtttcctctacgcccttttccgtcagcttcgtccgcaccatgcggtcgggaacgaggtagcagtctgtggcgccgttgatccactcggaatggctgctgatgtccgtaatgcacgttattaacggcatccggctgcctgtcaccgccttataccaggacatgatctgggaacagaggggcagggttgagatgaccgcatccggctgttcctcctccagcagattttttattttctttaaaaaccatggaagaaaaaccggtttcaaatccggtcccttgcgttccatatgattataatacttattatacgttccgctgcagtgagtgaccataacgccaaaggcgtgataaaccttgtcggaataataaggcattgcatactcaaaaatatcgcggatcacgatgtcagcctcgggattcaccctcgaaacacgctctgccagcgaaaaagcggcagaataatggcccataccaaattttccagtcaaaaaaagaagcttcatatccgcacctcatttcattcttctttatcctggttttagtatgagccataaatctttagaaacggctgtaaaatttctgaaattttcttcagaaattcttatcatgactgctgttttttctttttgaaacagaaaactgctcctcgttccattctttttctggaagcttcatcgatgtgtgataacgatagtcatggctttcgtaagtaaagctgcctcccatcttttcaatcatctgttccgacgccttgacgccgattccgtagctttccacctcgatctcctcgtcccgtatgggattctcgatgttcaggcagacgaagccgtctgaaagcctgacctccacggacacgatgccgtctctgcgcgcgtacttttcgatattcgttccaatattattcaggacgcgttttaactggaccacatcggtctccaccgcaaacggcgtctcaatctcgtagcgcacctccgtccggaagccgtgttcctccagggattccgtcagatcaccgatcagctgcccgaacagttcatttccgtcgtactcctcgtttttcagggaaaaacggtctcctgtggcataggaatagctgaataaatcgtccatcaggttcttcatatggtatgcctggcgcttcgccttctccatataaaggacggactcatccgccgtgcatttgccagccgtaatcaaatccaggtagaacagaaccgaggtgagcggtgtcctgatatcgtgggacagggctgtcacgatctcgctccgctccttttcaatccggtccttttcctcgatctccttgtgcaggctttcactcatctggttgatgctgtctgccagggaatagagttcatcccggccttttaagggaatttcgtaccctctggagccggtctccaggatgtggatccccttctcgatctgacggatatacgccagctttttctgaagcagcacgaggaataccacgacgaagcagaccgcgctcatccccgctcccaggacgagaatcagtgtccggaacctggcctcaaagtaggcccggatcaggatctccccatccccgtcggcaaacttcaccggataggtaactgctgtcccgtggcggtataaatacccatactgaaaccccgggtgctcgtccttaagctcggtcttcagcttctcattatcccggtccatggtattatagtagatgcggtcccgctgatataccgtcaggaacacataccagttctcggaattccagtcaccgatggtctccccgtctccgatctccacataattttccgtgacgaaatcctgaaattcctctgccagaagcttcgtatgccgctcataatagttcttctggtccgtcatcatgccggccagaagccccatggcgttcgtcaccgccacatagcagagaaaggcggccgccgctgcgatcaccacatcatacagcgtggcaaggcttaaacgcgtgggattcgccattttcttaaggaaattattcaatataatacccccgcccccacatggtctttatgtattccggattctgcgggtccttctcaattttcctccgcagattcctgatgtggaccatcacattgttgttggcggagtaaaaatacggttcattccagacactctcgtagatattctccgaggaaaagatctttctcctgttctttaacaggaggacgagaatacagtattccctggaggtcagattcacatcacggccttccacggtcacggtccgcgtgtcctgatccacggaaaggtcccccagcaccagacggttgtccggcgcggcgaagctctttccctggtagacgagatacctccgcagaagcgatttgcacctggaaagaagctccgaataggaaaagggcttcgccagataatcgtctcctcccgccgagaaacccatggatttatcggaatcctgggtgcgggccgttaaaaacagtatgggcgccatagactttttccggatctcggagcaggccacgtagccggacttaaccggcatcatcacgtcgagaataattaagtcgatggtgtcgtccgccagcatgaccgcttcctccccgtctcccgctgtcaccacctcgtacccttctccggtcagaagtatctgcagaatctcgatgatctcctcgctgtcatccgcaatcaatattcgctgtgccatcgcgcagacctccttccccgatccgccgcttactgtacggcaatgtggcacatcttcatcgcgtttaaggcattttcatggctctccggcgagactcccgcacagcatgaggaatccacgagaaccggcacctccgggatcgcggccttcaccagcagcgcattggagatgacgcagatatccgtacagactccgatcagcatgacagactcatacggccgttcctgaacgtattccataagggcggtgcttccaaaggtattcttctcaaaccgcttcccctgaaattcctttaaggcggaatccagctcccagccatcggtgcccctgatacagtggggaaccggcagattctttccttcctgggtctccatatacttttcatcgtgggtatccagcgtgaagatcacatcctctcccgccgcctgatactcctcgatcatcttttttacattgggtacaatcgcctgcgcctcgggacttcccagcgcgccgtctataaaatccttctgcatgtccacaacaattaagagcttcatttgtcaaacctccatttttacagatatttgctttagtttaccacaatttgatatccttaggaagatatttcctcgatttttcccgcaggccgtagtatactgaaatcagaaacggctgctgtgccgtaacgaaccagaaagaaggatatttgtatggaagagaaaaaaaatccctttgcatccctgtcggacaaagaactggaggccatgttaaaaaggctggaggactccaacgaacgccaggcctcctacgcgaaaaagcagtaccggatgtcccagattaccgcgctggccagcattctgatccttgccatcgtcatctatacctctgcaaccatcatcccccgtgtcaaccggcttttcgacgatgtggagacggtgatggacagcgtgaacgtagtggcaaaagagctggaggaggcgaatttgggccagatggtaacggatatcgacaacctggtaacctccagtgaccagagcgtgaaggaagccctccagcagattaattccgtggatatcaagacgctcaaccaggcgattcaggacttatccaacttaatcagcccgctggcgcgatttttcggaaaataggtaacagttcagacggcgggaaaatagaggaaatacgaaggaatttaaaaatagtagttgacaaatccactttgacgcattaatataataagcaataaaataaaccgttgaaaaagaggagtaagctatcccgcaatatttcagagagtcgccgccggtgtgagtgcgatatagagcagacagctgaatggacttttgagggcggtcctgaaccatcaggtaagtagggaccgacggagaccacaaccgttatcttcgtggcatatatgttagtatatgaaaagcggacttctatggaagtcaatttgagtggcaccgcggatttgttaattcgtctcaagtatgtttttagaacatacttgggacttttttatgtttaaaataaaatatatgattcatgaggaggaaacaattatgaaaaaaacaatgaaagcactcttactcgcagcgatgacagtaaccgcactcgcgggctgttcttccaaaccggcggatccgacgaccgccgccaccgaggctgtaacgaccactgccgccgattccgcggccgacaccaccgccgatacgacagccgcagaaggcgccgctaccgaagacggcaagtcctacaccatcggcatcggccagttcgcggagcacggctccctggacaactgccgtgaaggcttcttacagggactggcagacgagggaatcgtcgaaggccagaacttaaccattctctatgaaaacgcacaggcggacggcggaacggccagccagattatcaataacttcatctccaaaaaagccgatttaatctgcgccattgcgactccgattgcacaggctgcctacggcggagcgaagaaagacaacgtacctgtcatctacactgctgtaaccgatccggctgccgcggcgcttgcaaacgaagacggaacacctgtcggcgaagtaaccggcaccagcgacaagcttccggtagaaaagcagttagagatgatccggaagattcttccggacgcgaagaagatcggcattctctacagcaccagcgaagtaaactccgaaaccgccatcgcagaatacaaggccgcagctccggattacggatttgagattgtggaaggcgccgtaacctccaccgccgatatcccgctggctgccgacagcatcctggaaaaagtggactgcttaaacaacttaaccgacaacacggtcgtaagctctctcccgatgatcttagacaaagcctccaagaaaaacattccggtattcggaagcgaggtggagcaggtcaagatcggctgcctggcttccatgggtctcgattacgtggatttaggaattcagacaggtaaaatggccgccaaagtgttaaagggcgaaaagaaggccagcgagatgaacttcgaggtgatcgaggaagctgcattctacggcaacagcaaggtggctgagaacctgggcatcgcacttccgcaggaattaacggattccgcggctgctatctttgacgaaattacacagtaatatactacttctcctggaggaaagctatcatgtcaatcatacttggcgtttttgaagagggcctggtctatgccatcatggcactgggcgtctatatcacatataagattctggactttccggacttatccgtggacggaacatttccgcttggcggagccgtaacggtcacactgatactggccggggttaatccggtgctcacgctgttcgccgcatttgcggccggcgtcctggccggatgcgtgacgggattcattcacgtaaaattaaaggtccgggacctgctgtcaggtatcattgtcatgaccgccctctactccgtcaacttaagagttgcgggtaaatctaacgtaccgatcttcaacagcgattcgatctttgaaaatgaatttgtaagccgtatttttccggccggcatcagtaatttcaccgtcgttatcattctcgccgtgatcgtgatcctggtaaagcttttactggacctctatttaaagacacggtccggctgcctgctccgggcagtcggcgacaacgacacgctggttacctctcttgccaaagacaagggcatggtaaaaatcgtggggctggcgattgccaacggcctggccgctctggccggctcggtctactgccagcagaagggcttctttgagatcagcatgggtaccggcaccatcgtcatcggcctggcaaatgttatcatcggtacgaagctgttcaaacgtgtgggctttgtcaaatccacaacggctgtcgtcatcggctccatcatttacaagggctgcgtctctctcgctatctatatgggcatggaggcctccgatttgaaactgattacggccgcgctgttcctcgtcatactcgtactcagcaacggcagggaaaagaaggtgaagagtcatgcttgaattaaaacagatcaataaatactacaatcagggaaccgtcaacgagatgtgcctcttcgaggacttcagcctgactatcagggaccgccagtttgtctccgtggtcggaagcaacggctccggcaagacttccatgttaaatatcatctgcggaagcattccgttggacagcggacgcatcatcatcggcgggaaagacatcaccagcatgccggaatacaagcgtcagcgccgcatcggccgcgtataccagaatccggccatgggaacgtgtccgcacatgacaatcctggagaatatggccctggccgacaacaagggcaagcccttcaatctccttccgggtacgaaccgccagcgaatcaattattataaggaacagcttcattctctcggactgggtctggaagataagctgcatgtaaaggtcggcgtactctccggcggccagcgccaggccatggcgctcttaatgtccaccatgactcccatcgagtttctgattctcgatgagcacacagccgcgctggaccctaagacagccgaggtcatcatggagctgacggaccagatcgtaagggaaaagaacttaaccacgatcatggtaacccacaatctgcgctacgccgtggagtacggcgaccgcctgatcatgatgcatcagggcagcgccatcatcgactctgcagatgaagacaaggcttctctgaaggtggacgatattctggacagattcaatgagatcagcatcgaatgcggaaactgatctctattccagaaatgactttcttttaactaaaagcttatcatcacaaagaaataccgctgccggaggaatcttctctttaaagaattcttccggcagcggtattttctgtatttcctattaatccggcctttccaggatcattatctcttcctcttccccatagaacgcgatctggttcttgccccgtccttttgccatatagagcgcctcatccgcgtgtttatagagtaattcaaacgtattcccgtcacgggggccgaaggcgattccaatgctgatggacacgatgcgttcctctccgttcagcgtcagggcgtatacctggcggcgtacctcctccgcccggaagctggcgcactcacagttcggtatgtgatccaggaatacgataaactcatcgcctccgaaccgggcaataaaatcgtccgaccggaacgcacccgagagaatccgcgccatcttctttaagaccgcgtccccctcctgatggccgtatttgtcattgatctccttgaagccgtctaaatccagcatgatcagacaggacaggctgtcctcatttttcagagcctgctccaccttctcttcaatattccttctgttgtagagacctgtcagcggatcccgctctgaagaatacatcagctccatcttccgcttcgtctcctcatccacatcccgcacataggcgaacgccaccggatttcccgagaccggctccgtcagcagggaaatcgtacacgtcatccatttatagtcctccgagcccggatacgtcgcgcgaaacaactccttttgctcccgctctccggtataataagctgccagcatccggttggcctgcatctgcccggcgatcctgtcatgatccgccggatggatgtagcggcacatattctcgatgaaccttccgctgtacagaaagcccttgccgccttccagccagtcttttccatgaatggtgcaggccatcacctgctgcctcacgaggtccacggaccacatggcgaccgcctccgagagaagcgccgcacggtactgctcctcctgggcgaaacgcctccggatccgccgttcctccgtaatgtcctccagcgttccgatagccttggccacctcgcccttaccgcctctcaccggagtcacggacagccggaaatacgtgtcctccgaaaaggaggttccgcctgcaaattccagcggccccggttccctgccctcggcgatcctctttaagatcatcttccatttttccagatcctctgcggccaccagtcccacggcggctcccttcgaggatatctggtttaaaacagtcgggaattccacctccttcacgaccggaggcgaaataaagctgaggctgtcatccttcggcacatactcgaacgtggtgccggtggaatgaagaatcgccagttccagctttttcttctccagctccagggcctccttcgagtccaggatgatatttctcgcctttctggaccagagaatgatgaccgccagctgcgccagaaaaagtacgagcatcttcaacgtaagatataaggctgtctttccgatgtgctcgcggtaccagttggaaaccgtatagggaaccacggtgagcacgtaccagtcattgatctcggccggcgcatagtatacgatccgcttctcattcgcggccgtaaacaggaagacgcccttctccttccgctccattttcttctgcagttcgctgacggcttccgcccccatatccgtatcgctgcgcagaaagctgaaatattcccggccgctgtacaggctgtccgcatggttcgtctgcatgattaccgttccgtccgacttcaacacgtagctgtagcttccggaattaaacccgttggtggttaccatgtccaccatctgatccacgatcatgattccggcgattccgccttccacagtcttttcccgcttcacgggcgcataaaaggcgaagacctcctgtccggtcacgctggagagaaagacatccgtcatcccgctttcccctctgcagatcccctccacatagcctcctaccgactggggaagagcctcgtgcccaacagtgtaaaggcctccatctgccgaaaccagccggatattggcgaatccgcacttctccttcagctgctcatagactctctggcgggcttcctccgtcagttccggcgtctccgacaggaaatccgccgtataccgcacttcctcaaacactctggtcagttccgtctttaccgcagtctgggactggtcgttgacatccgcaaggtgttctgtcgtcatgttggtcatcagatgatcgacacgtatcgaaaaatcatacaggaacagatagataaacaccagaacgagtatgacaagcaggattaccgttctcacatgattccggctgacgctgttttcctttttcatatttttcctccttgtttcctacaggtcgccatttacgaatcaagcagcagaaatatgtcagggatggccccttaaaaaacgatctatgagagaactcatttgatgccggcagcgtttcttttatacacgaaaaaaggcttcagtcagattaatctggctgaagccccaaacatatcgtaaggttttagcagctggctgcccatacggccctttagctttgcgtcgctgcctttcgacagttttgccattactaatataatagattcagaaccccgtcttgtcaaccataattttccagttttaccggctcatttcgctctgcgggcctttctggttgtgctcacggattatcatgttcatttcctctaaatccgaggtcggcaggtcgccggggatggtattttttaaggcgctggccgcgttgccgtaacgcaccgcctccatgcagtcgccgccgctgctcaacagtccgtataaggcgcccgcgatataggcgtccccgcttccgatccggtccaccacgtctatattgcggtagggctcttcctcgtaatactcatctctggccgcgtcgtaaatcacggagccgaaggtatggctcttcgggctgtgcaccactctctgggtggacgccacgatggagatcgggtactcctctgtaaagctcttcatcatctccctggccgttcccgtcttctgaaaggtcagccgggcggtgtcttccgagcagaagaaaatatccacatagggaagaatctgctcgatgcactctctcgcttcctctcccgtccatagattcccgcggaaattcacatcgaaggaaatgatggtgccagtggatttgaacctgcggatcatgtcaacggcggtctttctcgtgttttcacacagagccagggtgattcccgtcgtgtggaaacaggttgccgcacggtacatgtcctccgggaacgagtccacgctgatgctgtaaaaggagctgttctttctgtcgtaaataaccttcggttttctggggtgggcgccgtattcatagtaatagaggcccagtctcgcatcggagctgtggtcatagacaaagaaatcatcgctgattccgtaggaacgcactttattttttacgaaattgcccatgtcatgggatggaagctgggtcaccacgccggtgtgaagtcctaaaagggccgcgccgactgcgacgtttaactctgctccgcccacctgcttctgaaatgaatcaccgcgcaccaggcgctccactccggccggagataaacgcagcagcagttcgcctaaacttaacaaatcaaatggtctgtcactcatgatcgatcttcctcgcttctaaaaaggggccattctgcaaaagcttataaaagctgattagaatgaccccgctgtcttaattatctctgtacacgtcctgagccgtctccgcctgcaaggctttcaacgtcctctcttgtaaccaggttgaagtcgccagggatagtgtgctttaatgctgaagcagctaccgcatactccagtgcactcttataatccttgccgtcaaccatgccgcagatcacgccggctgcaaaggagtcgccgccgcctacacggtctacgattggtgtgatgtggtactttctggagtgatagaactcacgtgttgcgccgtccatgatgcaggctgaccagccgttatcggaagcggaatggctctcacgtaaggagctgataacatacttgaagccgaacttgtcgatcatctgattgaagatgtcaacatagccctgtaactccagctcgccggaggttacgtcggtgttgcccggcttgaagccgagaaccttttctgcatcctcttcgttgccgatgcatacgtcaacgtactgcattaaatttgtcatgaccttctgagccttctcggaagaccataatttcttacggaagttcaagtctacggaaacagtaactccgtgagccttggcagccttgcaggccgcttctgtcagttcagccgcagaatcgctgactgccggtgtaattcctgtgaaatggaaccagtcagcgccctcgaagatctcatcaaaattgaaatcagcttcagttgctgtggaaatagaagaatgagctctgtcataaacaaccgtagacgctctcatggcggaaccggtctctaagaagtagatccccagtctctcgccgcatcttgcgatgtgctttgtgcatacgttgtactttctcagtgccgctactgcgcattcaccgatcgggttcttcggaactgctgtcacaaactctgcgtcatgcccgtaattagccagggaaactgctacgtttgcctcgccgccgccgtaatttacgtcaaattcatctgcctggataaacttctcattgttcggggtagataatcttaacatgatttcgcccattgttactacttttgccattatttaatctcctttttcaatccattttctgatttgatgccagtgctggtgcatggcgtatttacgccgggaggcaccaggtattgtcttaagcgcgtgctgccgcaactgcctttacaaattcctgagcctttgctgtaactgccgcgaagtcgcctgtcttggcgccctttgtcaggctgctgccggttcctactgcgtaagcgcctgccttgatccacttgtccacgttgtccacgtcaacaccgccggacggcatgaattcgccctgaggaagcgggcccttgaaggagctgatggctgccggtcccatgatgttgcccgggaagatcttgataacgtcacagccgcactctaatgcggtgatcgcctcggttggtgtcataacgcctggaagcatcgggactctgtagcggttgcacattctgatggtatctgcgtttaagccagggcttacaacgtagttggcacctgccagaataacggctcttgctgtctccggatcgagtacagtacctgcgccgataacaacgtctttgttatctctatatttttcagccatcttcgcgatgaattcaaccgggttgccttcatccatggtcatggtaatctcaataaagttaatgccgcctgcgatgatggcgtcaaccactttctcgccctgctccagatcctttgcacgaacaacggctaccaggcagtcttctttcatctttgctaaaacctgttcttttttcatgattgctctctccttcttattcgcatatacgaatgtctttcataattgcgattcttatacttgaatattaatcgtttctcttcattttgtcaacaggtaatctttatatttttccaagaaaccctaacagtcttgaaacctcctgtccttttgccgcgacaagggctcccagcgcctcgtaatcctcggtcggcttgtataagctggacacgctgatcgctcccagacaggaaccatcccggtcgaacacgggggcacccacacactgcatgtgctcttccatctcccgcgcatcgaacgcgtacccgcgctcccggaccttctccagctccttcaaaagcgattctcttcccagtatcgtccgatccgtatgcctgacaaatttaatcctgtttatcacctgctctctcgtctcctcgtcactgtatgcaagaatgacctttcccagcgaggtgcagtacatgggattcttcgagccgaccgtcgccgtggtaatgatcgggttttccggctcaaacttgcatatgtagacaacgtggtggtcggaagggattccgaaaaacacggtcttgcccacttcctttgaaaatgccttgagcaccggttcaatcgtgctgataaaatccagattattcgtatagttaattccaatgcggtaggccatcagcccgatggtatagctctgcttctgccccctggccacattgaccatccccatctcggccagcgtcgtcacaatatcgtaggcgctcgtcttcgggagcttcagcttctcgcagagatcatcgagcgtcgctccctccggtgttctggaaatcatctttaaaatttccacggttctctgtgtcgttctgttcagtttcatgttatgcctccgttcttactcctctagtatacctccccgggcctttaaaaggcaatatgaaatgctctcctacgaagtatttgtaagtatttacaaaaatataacacgtttctatgcaaaatgtcaaaatgattatgctacgcccaaattcttgtggggagggggaggcggggaagaggacagacttcttgtttcctcggcggcaggaactaaagccggaaggcaggaaaaaagggcggatcgcgcaaattacggagaactcctgaaggacttctccgtaatttgcgcgatccgcccttttttcctgccttccggcttaagttcctgcgagcctcggaaaaggaagcctgccctcttccccgcctccccctccccacaagaatttgggctgtgtactggctgctccggaaaaaaagcaaaaacaaaagcaaaaacaatactatttcataaatataaaacactaaaacctccaacacaccagcgggtctgccatcctggctcccgaggtacacagccccgcgccattgcgtcaggcccaggctgcgggcggatcggggtgggaccgctatggttattccagtgtgccggcatctggatacgaatcataagaaagtccgagcctggcgaacgcgcccgtatttggcgtgtacgacaggttcgaactttcttatggtgagtaggaagcaagacggacacggaataaccatagcggtcccgccccgatccgcccgcagcctgggcctgacgcaatggcgcggggcgtaccccccccatcacttaacggagcccagcattccttctacgaagctcttctgcatgatgaagaaaatcgctgcagtcgggaaggtcgccgttacgatggctaccatgatcattccgaagtccggtgtgtaagcggagttcatggcggatatgatcaggggcagggtcatcttgtcgtcggtctgaagggcaaccagcggccataagtagctgttccagatgttcataaaggtgataatggtggccgccgcgaaggtcgaacgcatgaccgggcagtaaatgaggaaaaaggacttcatttctcccagtccgtctaccctggcagcctgaaggatttccttcgagaaggacttcgtgttctgacggaagaaaaagatcaggaacgcggtcgccatggacggcagaatgacagataaaaatgtgttaagcagtccccattttgcaaacatgcggtagcggggtatgaggagcgttgccatgggtaccatcatggacatcagaaggagcgccatgaccttatccttgatccggctcttataaatctcaaatccatatccggccatggcggctaccagaaccgtcagaaccgtggcgattaccgtaatgatcatggaattcttgatgcccgtcacaatattcgtcgtagtaaacagcgtgtgaatgtttgtaaacaactggttccccagcatcatcctgccgcttgtgatatcgacggaggcattggtcgcactgatgatcatccacagaaacgggaatatggacagaaaagacgcaatgcataagaatacgtattttgctgtttttttaatcatttttcttacctcccgtcactttaaactggattgctgtgagaacgacaatcatcaggagaatcgcataggaaaccgcagatgcgtatccgaagtcgggcgtgtatttaaagcagagattgtagatgtactgtgacatcgtaatcgtcgcgttgcccggtcctccctgggttaagtttactacctcgtcaaacagctggagtgttccgctgatcgacgtgatactggtaaacagaataatcggcttcaacagcggcgccgtaatggaaaagaacttctggaccacattggctccgtcgatctccgcagcctcgtaaatctcgggatcgatattctgaagcgcggataaaaagaagatcatgttgtatccggtccagcgccaggtgattgcgataatgatcgtaatcttcccccagaaggcgtccgtcagccagtggatcggcgactggatcacatgaagtgtcatcagcatctgattgataaaaccgctgtcggagaaaaggctcttaaagaggaccgcataggctaccagagaggtaacgcacggaagaaagatcgcaatgcggaagaagctgcggcatttcagtttcttatcgtttaagagcactgcgtacagcatggccagaaaaagcatgaccggcacctggacaatcaggtagagaaatgtattttttactgaggacagaaatatgggatcgaccagaagccgtttatagttagccagcccacagaaatggagattcatccccattcctgtctgaaatgaattggctaacgctcctatcatgggataaaagcagaatatcactataatcagcgtgccgaaaccaatgaataaccatccctttataacgctggatattttcttactattcattgttttcctcccaaaggtcttaccgggcctgtgcttccgcctgaacctgcatgctcttcatggcggcgtcgatgtcctcgccctgcaggattttctggatttccgccatcacgatatcctggaacgcataggtataggtaccatagtttacattcggaatttcttttgtaatggaggcaatctcctggtaaatcttctggttgccgaagaacggaatttctttattatagacatcgctctcctgagacggtaaatacgttcctacgattcccttctcatccagcagctggttgtaaagctctttgttctcgccgaaggtggtttttaagaaatccagggcgatatcggaattttcaacgccgtttaggatgtaccagctgccgccgcctaagttggaagcattggttgcattggggacactgtccagtctcgggatctttgcaactctccacaagccatcctgaccttcccctttcataatagaaggagtaaaccagcagcccttcagctgaaatgccacttcgcctttattcacgccttccaaaaggcccgcccagccgctgtacgttctgaccagatcgtcatcggtgatggtcttgatgatttgcaggcattccttgagcgcggcgttgttctccatgttcggagtcgttccgtcctctttcgtgaaccaggttccggcagactgcatggtcagcttcattaactcaatgtcgctcgggtccagagaaatcatcttctttcctgtagcctctttgatctttctgcccatctcgataaattgcgaccaggttaaatcctgcatatcttcttcggtatatcccgcctgctcgatcatgtccttgcggtagtagatgacagcggctccgttgtcccacggaatgccgtaggatttcccctccagcgtcatcggtccctttttatatgcggcaaaattgtcgtaattaatctcggaagtcagatccataaatgctcccggatacgattttaagaaggactgaatccggtaatcctcgatgggaaccgcattcggaaggccctttaaggagcctgatcccaggccggtgttcagcttctgtaccacatcattctgaccgacctccacgatgttgatctccacatccggatgatccgtctcgtagatttccttcgccatctccagcgcggcaatattgaattctttatcccatgcccagaaggtcaccgtctttttgtcccccgaggaggtgccggcagcttcctgtttcgtcgtcccctccccggtctgcgttcccgcgttgtcaaccggtgccttgctcccacaagcagtcaggctggcggccagcgctactgctgccgcaaacaaatacatttttttcatctctgtcttctccttttctatatgatgcctttattttatcgttatatctcacaaaaatatcgtattttatttggaataatacagcatcatgtgattaaatccatgcgaaggcaaaagaaaaaaagtacttttttataattttggtaattttttcaggtgataaggaagtctcaggctgaccgaagtgccggttccgatcacactgtgtatggtcacgccgtactcctccccgtagatcagccggagcctttcatggacattgggaatgccgattccggtcagatggcgtctcctgtcgctgctcagcaggtccgccgtctcctcctgtgacatgccgtctccctcgtcgataatttcacagatcaagtcatcccgctgcttctttgcaaagatccggatcttcccctccttcttattctggaatgcatggaaaaaggcgttctcgataaatggctgcagaatcagcttgggcaccatgcattccatgccctcctctgccaggaaatactccacctcgatgcggtcgccgtaccgcacctggttgataaacacatactgccggaccagatcgatctcctcccgcagcgtgatctcctcctccatgtttccgatcgtcttctttaaaatggcgatcagcgcattgatggtatccgaggccttctccgtgttgttctcccaggtgagatacttgatggaggccagcgtattatacataaaatgcgggttgatctgcatctgcagcgcctcaatctccagacgccgcccccgctcctgctcctccatcagctgtttgacgtagctgtcaatctcatccaccatccggttgtagacatccgccatctgcctcacctccgagttgcctttcacagggctcaccttttcgaatctgcggtttttaaaggtttccagctgctggatgaagaaattaaggggcgatacgatgcggcgcatgatgaggaataccacggcgatggctgtccctgtgatcagaaagccagtcacaaggatattacggcggattcccgcgtaggattttaagagggccgcttcctccaccgtgttgaccatgtacatatccagctccggtatgtatcccgatatcacaatctccggtttatggttctcctttacggtccggtatgtatctccgttctccctcatcgaacggaccagcgagagcagcttcgtctcctcgcttcccagactgtcttttacattacccgacacgatctggccgtcggaagacaggattaccatgcggctgccctccggaacggcctcgctgaacatctgatagaactcctcctcgggaatcgtaatgtaggctgtggcaaagctttcgctggaggacggaagaaacaaccgccgcgctgctatcacgcatttcctgtccttaaaatcatcggtaatgccatggtcctgatacgtatactggagccgtctgctggtctcgctgatcttcagggagcagggcatgttctctatctcttccacaggaatcgagattctctcccctgtgaaagagaacgcgctgccctgattgctgaccgcgaccaggttctgagccgtgccggaaggcacggaatcgtgatagaccttcaggatgtcgtacgtcttaataaatttctccgtgccgcaggcgtcggcggcgagaaagtaattcttcaaggccggtttcgtctccagcagccttaagagcattaaataggagttgttgttttcttccacctttttcttgatgttgtccatcagcttggcatttaaaaaggtggacgactggatgaaaagattcttcgtgatccagtccgaactggcgatggtgcagaaattggtcaggacaatgctgctcaccactaccagggaaagcttaaaaaaggtaccccaccgaatctgactcttcataatttttccccctgccgcctcgcccggttccgatatgtatgcggagagtagccggtctgctttttaaagacctttccaaaatagctctgatccgtatatccgatttcctgcgcaatctccgacagggaaagctctgaggcggtaagcagctctttcgccttttccacccggaccgagtttaagaattcattgattccctgccccatgtgagaggaaaagtacgaggagaggtacgaataattcatgttaaaatccgcagccagagtcttcagcgtcaccggttcgctgtaatgccggtacaaatactccgtgatcctcaaataaaggccgctccccctcgcctcctccgtaatctgcccgatctcctgatagatggcggcaatggctccgatgagtccctccaggctgtcggtggtgccgatggccgtcaggaaggacagcttgcgctcttccagctggggcgggcagaattcattttcattcagttcaaaaatcgtgttatagagcgtactctccatcagcttctttacggccatctcgctgaccgccatgctccgcagagagcttaaatactccaccagcacggctcccgcggttcccgccttctgctggcgcaccagatcgcacacggtcttctggtccagggccggaagctgcaaaatcccggtctctctcagatcgagataatctttcctgctgtcgaaaaaccggtaggaaaacagctccgatagcttctgtgcctccgtctccagcgagacgccctttccatagggcgggctgataatcatctcaatgttgcgcagataggcggtgccctgcccggtcatcgtgcgcagcttttcgtcaaacatttccgggtaaaagcagccgatcgtgtagatgtacacctggctttttttcagcataaagctgtcaagatagaaccgcccgaacgcttcctttatcatctcctccatgtgcccgatggtaagctcctgcttgttggtcgccccctggaggatcttccctggctgtatggcgatcagataataggtggagcaggcgtccccctgctccggacacgcttcctctccgccgctgctcccgtgatccttggtatggatgacccccttctttctgcctaagaggcggagcgctctaagaagatagtcggattccagctccggtttcaggatataatcaaaaacaccgtatttaaatgcacttttgacgtattcaaaatcctgatatccgctcagaatgatggtggacacctccggatactttagatttacggcacgcaaaagctccagcccgttcatccgaggcatcataatgtcacagatcatcatgtgaggcagactctgttccagaaactccagcgcctcctccccgttcgtcacttccccgatgatctcgaattcatcgctctcctgttcgatgatgtagcgcagcgcctttctgaccagcagctcgtcctccacgatcagaattttacatttatcacactcgtatcccatttcccgtattcctccctgtattttcccataatgatcacccgcttgtactgctcaggagtcaccgcggcattcaaacacccgctttttgcggaaatatccctgctttctagtataactcctgtaagtatttacaaacaaccacagttcttgtacagaatttgttaaaattatattctggggattgtaatatttatcagatgattgtataataaaagcaatatgtaaatacttacattttccaaggaggtgatgttttgaatatctacgatgtttcagaacgggctaacgtttccatcgctaccgtttcccgtgtcatcaatggaaatcccaatgtcagtgagaagacgcggaaccgggttttggcggtgatggatgaacttggctacacgcccaatgtctttgccagaagcttagggcttaacaccatgcgcaccatcggcatcatgtgcgcggattcctccgatccctggctggccggcgccatctactatctggagcaggagctgcgccgcagcggatacgattccctcctctgctgcagcggctacttgccggagacgaaaaagaagtatttggagctgctgctctccaagcgggtggatgccgtcattctggccggttcccactacgtggaggccaggcagaaggataatgcctatctcatagaggcctcaaaggagcttcccatcatgctggtcaacggctgtctcgacggcaaacagatctacagcacggtatgcgacgaccggaccgcggtctatgaatcggtcaccaggctgatccggtccggccgtacttccgtcctctatctgtacgcaggcagttcctacagcaatctgcagaagctggcaggctatcacgatgcctgcgcggcagccggcttgaatatccgcgacgatctggtacgcatctgtcccaaggatttagacggcacggaagaactcctgcgttctctcgcctccgccggtttgaaattcgacgcggtcttcgccgccgaggatatcatggcggtgggcgctgtcaaatatgcgaataagaccggaatcaaaattccggaagaaatgaatattatcgggtataataactctattctgtcccgctgcaccgatccggagctgacgaccgtcgacaacaaggtggaatcgctctgcaccactacggtcacgacgctgatgaaggtcctgggcggcggaaacgttccggtgaaaaccaccatctcggcagagctgatcaaacgaggcactactgatttttaatgaatgcaacaagatttccccgcctctgcaggtgatgggattcattgtataaagaagcaaaaaggaggattttatcatgaaacagtttatggacaaagaatttttactgtctacggatgcggccagggacctcttccacaactatgcagaaaaaatgcctgtcgtggattatcactgccacatcaatccgcaggaaatttacgaagaccgtaagtttgacaacatcactcaggtatggctgggaggtgaccattataagtggcgtcagatgcgttctaacggcgtagaagaacaatacatcaccggagatgctaacgaccgtgagaaattccagaaatgggcggagaccctgccgaagctgatcggcaacccgctgtaccactggagccatctggagcttcagagatatttcggcttcacaggatatttaaacggcgacaccgcagaggaagtgtggaacttatgcaatgaaaagctcagccaggattccatgagcgtccgcaatctgatccgtcagtccaacgtgaccctgatctgtaccaccgatgatccggccgattcgctggaatggcatcagaagctggccgcagatgattcctttgaagtgaaggtgcttcctgcctggagaccggacaaggccatgaacattgagaaagtggattttgctgcttacatggcgaagctttcaaaggccgcaggcatcgaaatcaccgattttgcctccttaaagctggcgcttaagaaccgtatggaattcttcgcctccagaggatgcagcgtatctgaccacgcgctggaatacgtgatgtacgttccgtccgacccggttgaactggataccattttcgcaaagggactggccggcggaccggttacccgcgaggatgaattaaagtataaaaccgcattcatgctctttgtggccaaagaatacaaccgcatgggctgggtcatgcagcttcactatggctgcaagcgcgacaacaacgcgatgatgtatgcaaacctcggaccggacaccggcttcgactgcatcaacaactacgctccatccgctcagatggccgatttcttaaacgcgctcagtgcaacagacgagatcccgaagacgatcatctactccttaaacccgaatgacaacgcctccatcggcactatcatcggatgcttccagagccagttcccgggtaagatccagcagggttccgcctggtggttcaacgaccacaagacaggcatgaccgagcagatgacttctttagcaaacttaggctgcctcggcaacttcatcggcatgctgacagactccagaagcttcttatcctacacgagacatgagtatttcagaagaattctctgcgaacttgttggcggctgggtagaaaacggagagtatccggacgatcagaaggctttgaaggagattatcgaaggaatttcttataataatacggtgaagtatttcggatttgatttataaattcatagcctgaagcttagggcatatttgaaaaaggaagcttatgcgttggcagacggtgtctgcagtgcgtaagcttcctttttatgttttacgttttatgtatggattcattacgaaattgcctgaaactccctcacacgactcatctgcctctgcagcaatccggttccgcgttcatacatctccatggtctcatagcgtctgtattcacattccagagtctggagaaccgccatatagatatcataccacagcgcccggcgttcctcggtttctgtaagcgtctctttcccatatccagccataaattctctgttgctgccgaatgtccggaatcccacttccagcagcggatcgccccacaggcttctctcccagtcgatgattccagtcacgtgttctccgtctgtgaagatgtttccggcccagatatcccagtgcaccaggcggggttctgtcacctcttcgaaaaaccggcggtctttttccagacgctcccggatctcgctgacgggcagcttcaaatcaaccgctctcgtctccgcgtcacagaggcccatatccatcatccttttaaaaacgggataccacgcatccccctggcattccgtctgtcccggaaggccgaaacgggagcaggtaatctcattgattctgcggtttatcgcaccggtctccctcatgagcgcatgtacggtttcctccgacagctcctgactctgtgaatagagactgtttcccctccgtttctccataaagaagtagaaggacgaacagatacttctgctgtcatcataaccatatatctcgggaaccggaatgagcgggtctgccgccgccctcttcatggcttccacctcggcaaacatgatatttttttcgtaggccatcacggggatgccttccgggggcgctacttttaagattacacgtcttccgctctcaaatatcacttcgtatgccacattgaagtagccttccgtcaactcctcatattccttcagaggatcatctgggaaatacttctctgccatcttccgaatcgtctctctgctctgtttattctttgtcaggctctccaaatcccgttttcctccctgaaatctcccatgaaacaaggaactctgcaatcagatcgatgcagccttccacatccttttcatcagccatctcagccggatggtgcatgtagcggagcggaatcgacaccagcacagtgggaattccttctccggcaaaatgaatcttgtccgcgtcggtatagctcagtctgctggctgcctccgtctgcactttcactccaattctggaagcgcattccctcatcatacggttcagccgcttggagacaatggggctgttgcagagtaccggccccccgcctaaggttacctcgccggaatccgcggcgttcatgccgatacagtcgctggtatacgtcacgtccaccaccacagccagatccggttttacgcggctggccgtccagtacgcgccgttcttcgtggtctcttcccccacggtggccgcgctgtacacgccgcaggcgcatccgcgcttcctggcctttttgaaggcctccataataataaatacgccgagcctgtcatccagcgcccggcttaagaaacggcctcccgccgccttgcagaatccggtgtccagcacgacgggcgcgccgggttccaccagttcacacgcttcttccttcgaatccacgccgatatcgatcagaaaatccgacgtcttcaggccgccttcctttttaaagaaatcacggtacgattccacaacaccgtatatcggtccccgctctgtcatcaccttgacacggtggcccggataggtggctggaacgatcccgccgcggtcgatcacctggagacgtccctgctcgtttaccgtcgtcaccatgaggccgatctcgtccaaatgggccgtcatcagaatcctgaaatcccggtccggacccagcacgcatacggtatccccaatatcgtcggtcctcacctcgtcggccagcggttccatatattttctgatgacggcctgtccctcttcctcatagccggataccgtcaccgcacctaaaagctcttccaaaaatacttcgtctgtcatctctattctgtccttcccagtctttttacactttctctgatcaccagcttggcggggatgagcgtctgaatggagatctctctgccggtcagaattcgctccgccaggactaaaaccgcctgttcgcccataaaatccatgtacaggtggacggtagtcagcggaggcaccagatactttgcggcagggatatcgttgtatcccaccacgctgatatcctcgggaattgcaagtccattttcgtgaaccgccttgtaacagccgatggcaagggaatcattggccacaaacaccgccgtcggccggtccggaagctccagcagctccttcatcatctgatatccatacttgggcgtgtagccgccgatctttacgtactcctcgtgaaacaggccctcctgcttcatgaagcgctgataggcgtatgtccggttgtccaccacctccgcgccatccgagtccgtctcgtatccgccgataaaggcaatcttttcatggccctgatccatcaggtatttcatcaccttcagaacagaccgctcgatatcgtggataacggaatcgaatttctccgtatcgggtaccgcgtccgcgaagaccgtaggcttctgatacgactcgatccgttccatcatggactggctgaacgtccccaggcagatgattccgtccagaaccgataagtcctctttcgtatcgccgctgttaatccggtacttcttgtatccctcttccgccagcttcttctcaatggccacacggacagagagataatacgtatcctccagctcctcttccagggaataggaataaaggacgccgattttcagcttcctctttctctttttcttatcctttacctggtaatccagctgttccgcaacctcgaaaatccgttttctcgtctcatcctgcacattcagtgtctcatcgtaattcaggactctggaaaccgtggcgatggaaactcccgctttctccgcaatatccttgatcgtagccataacgttattcccctcttatcccccataaaagtcaaagatcacggcaggccaatgtcttacaacgtgttcctgccgtgatactagtactgctttgcattaattccacagtaatagcactcgctatccacgccaggagcacgcctgacgcggatatcaagcactattactgcgttattaatgcaaagcagtactagtgccgccggacctagtgccgtttctaaagacctcactaagtgtttttagtatacctcgaagatttacgaattgcaagcctccaaaagctcttcaaaggatttcaaatggtacgccgcaagctcgcagtccgatgcgtcgccgatcccggcgccatccatgcctccggccttggcagccatgagaccggctctggcgtcctccaccacgaggcagtcttccggcttctcatggatcagcttcgcggccagcagaaagacttccgggtccggtttggaatgggtgatctgattgccgtccgaaacggcgtcgaagtaaccgtcaagtcccagctgtcccaggatgaagcaggcatttctgctggaagaaccgatagccagctttaggcctctctttctcagttcatccatggtcgccttcacctccggcgccagatccgccggtgacatattcttaagcagttctttgtagatttcgttcttttccgctgtatagcgttccttctcttcttcgctcatggcgccgtcatatctctcgagaataatctcaaagctttccatacggctcacgccgcgcagacggttgttgatggtctcatcaaagtagattcccagctgatcggctacctgtttccacgcctgatagtggtatttgtctgtatggcagatcacgccgtccagatcgaagataattccgcggtatttcataattccacccccactttttctttctttggttctgttttccccagctccttcttctctccggagtagttggataagatcacggccgccagaatcagtacacagccgccgatcatccgcatcgtcacattttcatggagcaggattacagaaaacagggtgccgaatacggattccatggagagaatgatggccgccttcgtctcatccacatacttctgacagtttgtctgaagaaggtacgtaagcgcggtactcactgcccccaagtatagcacactgagccagcctgtggaagtagcatgtacagaaaattgtccctgcgccgccagaaatacggcagacagaagaaatgccgttgccatctgtactgtatttaaaaccttaacccggtatttcggtgcaaactcgcccgtcaaaaagatctggaacgcaaagcccacggcgcccaccagagtcagcgcgtcgccggcgcccagggagagattcccgttcagagacagaattcccactcccacaatggccatgacggctccaacgattccattcatccctaccgtcttcttatagaccaggaaggcgataaacggtaccatcaccacatttgtggccgtcagaaacgcgtttttcgacggtgtcgtgtactggagccccacgatctgcagggcaaatccggcaaacagtgcgcagcccataaagaatccggcccgaatctcttcttttttaatgtctttcatgccgggcagagagattccgcccaggattacggttcccagaaaaaaccggaaggtcataatctggaacggggtcaggctctccagcgccatatcgctggctacgaagccgccgccccagatcacggtcacgaggatcagtccgaatattgccagatatttcttcatgactgtcctcctgctgccgggccggagccttccagaaccatcgcctcaccatttatgcggaccgacaccggaccgccctccagtactgtcaccgtcacgctgttgtccggcaggacagtaatctccatcttggatcctctgtgatgcagcttaaaggacaggccttcccactccttcggcatatgcggacggatatccacgacgccgtcttccgaaaatgacacgcctgcaaagccgaacaccacggtctgccacacaccgcctgcgttggccgcatggatgccttcccttgtgttcttctgtaaatcggtcagatcgatgaacgccgccctcctcaaatagcgataggccttcgtctcatcgcccacatggagtcccatgacagaatagatgctggggcttaaagaggagccgtgaagcgtccgtttttcataatacgtatagttctttcgcttcgtctcctcgtcgaattcttccccgagaagatggagaagcatcaccacatccgcctgtttgatgatctgggtctgcgtctttggcacggtccttaaaatctcagggcgtatgggccagtcgttctcatcgtaggcctctatcgtcacgtccttcagatcgaagtatccctcgaactgctccagcaggccattttccttaccctttggaaggtacattttctccctgacgtaagaccagctttccagttcctcgtcccggatattcaggcgggccttcagctcttcataaagccccgtcccgtcttccttccattccgttaaaagctccaggacatagcctaaattccaccttgccaggtagttggtgtatagattgttgtccaccggttcatgccattcgtccggccccgtgacgcggcggatctcgtagcggtccatcgtccggttgtattcgcaccggctggcccagaaacgggctgtctcgatcagaatctccgcgcctttttcacgcaggaagcaccggtctccggttattttcacgtagttgtagattccataggccacagcggcggttacatggtgctcgtaaactgccacgtagcaccggtagcaggtcccatccggttcgatggtccagtccgggcactgctccgtgccgtcgtccgccgattcccagggatactgggccccgcagcagccattctttgccgcattggctcttgccgcatccagaaggcggtaccggtagttttccaggttcctggccgtatccgggaacacgcaggcaaagaatggcagcatgaacagctccgtatcccagaacgcatggcctccgtattcctcgccgctcaaaagcttggctcccacgttgaccctgtcgtcgtgctcgctgcccgtgctcatcagatggaagagggtaaaacgaacggcgcggtccagatcaaaatcgccccggatctcgatgttggcctcatcccacatgcgggcgtacacctcgatgtggcggctcatctccatctcgaagccatcggcggcaaagcctttgatctcgtctctcacacggcagtgaagctcataatccgggacttcgcgttccgtatagacggaggcgtattttactacctccacagcctttccctcttctgcgtcaaagtcctgaaattccacagcggtttcgccaaacgctccgaagctccggttcttcatcacggttctgccccccgcataggcctccataaggcttccggttcccacgcagagcttccggtctctcgtcgtcacctccacataggcgcctttgtcggtaagcgggcagtttgtgagcagcctggtatgcttcaccttaaagcgaggcgcatcgcagaagtttatgacggagccatcgatgatattttccacctcgatgatcccgctgtagtttaacggcgtcacgaagaggcggattcccatgcggtggacattagcccggcttaccatccggattccttccacctcggtcctcctccccttcttatcttccaggacaaaccgtttggccagcagcgcgtgcttcatatccagagccctggaaaattccaggactctgcacgtctcaatgccgatcagctccttctccacatagagccttatccccagccagtccggtaaattggccagttctctcatgaaggtctctgatttatcaaaaacgccgtttatataggtacagggaatactcttcgccgcccgttcctcgtaggcacctctcgttcccagatatccattggaaaggcagaaaaggctttcgtattttaaattctcctccggatcgtaatgatcctcgaggatcatccacgagtcatcgcttaagtaattccttatgtgttctgaaaatcgctctcttatcacgtcttttccacgcttccttcctttaatccagatattttattttcgactgtgctacatcttccgccgcatcgactgcccgcatggtaaagctcagggcaaaatcctggcgtttcaccttatacgcctcttcctgttcctggccgcagctgttgcttcccagaccggaatggaggtagtccatatggatgatcacatcctccgcctccttgatctgccacggatactttgcttcttccaggctctcctccgtgtaattgtggatattcagccccagaggctgatccgccgtcaccagaagactgcgttccccgtcgccaagcgagtaccaggagacctcttcccgatggccgttttcctgcggatatacgtaattggtggacatgccgtccacatcggaacggtagactcccataaatgccgcttccctgctgtccgcataattctcctggaagccaaggccgtaccacgcggccttctgaaggtcctttgacgccttcatccggataccgatgcggggcagaaatcccggctccgctttcccgcgctgaatctgctttccttccaggcggcaggtcacagcgccgtctccgtacacagtatagtgatagtcgcacaaaaatccccacgactggtttaagcagccaaaatacgtaccgatcgtcacatcgacacggttctcatgctcttctgtcctgaaatactccatctgctcatccggaagctgtatgaagtatttgttcatccagtcatccttcttatacatatcgttgtctatggtagcccggtaaaccgtcacctcaggccccgccgtcacgtatggctttccagccaccgtccagcgctccagccggccgtagatcttatggaacaccacctctgacgattcgccctttactttaaagaagataccgtcatcctccgtcacaaggcggccgcccgcctcatggagcacggctgtctccagatgctccttaagcagaaactgcccgcgggatacttcgtggccctttccggcgtagggggcgtcttccttcagacagaccgacacatttaagtagtaatccgtattgctctccggcataaacggccggtatggaatttccagacggcagacctctcccggcccggcattcagatcttcgatcacgccctcttcctgtacggtctcatcacaggaaatccgccatttcgcgcagagatgggacaggctgctaaaatcataccagttttttaaaagaatctcgcgcccgctgcccgtcttcttccggatttccaccggagcaatcacctgccggtactcggcaagcgccggcgacggcgtgcggtccggcatcagaaggccgtcgatacagaaattcccgttgttggggaaatctccgtagctgccgccgtaccggtaatattcatggccttcctcatcctttgtgaggaatccgtgatcgtaccattcccagataaaaccgccctgcagccgtttgtatttgcggaacaggtcctggtaggcctttagacagccggctccgtttcccatggaatggccgtattcgcacatgacatggggtttttgattccccttttcgccgcggccgatctcttccagcttatccagccaggtgtacatggtggagtagacgtccgccgcctccgcctcgaaatcaccctcgtagtggaccagtctggacggatccatcgtccgcaccgcttccgcgctcttcacgaaattacagccgaaggcggattcattgccgagggaccacatgatgatggagggatggttgaaatcccgtcttaccatgcggacggcacggtccacgtaggcagtctcccacgcaggatcatcggagatccaggtatagttttccacccattcgaaaccgtggcactccagatccgcctcgtcgatcacatagaggccgtattcatcacacagatcgtacaggcagtcggcagccggataatgggaacaccggagcgcgttgatattgtgctgtttcatcagaatcacatcgtttttcatctgctcatacgtgacggcgcgcccctcggtcggactgtagtcgtggtggttgacaccatttaacagaatggcggttccattgacggtaaaattaccgtctttgatctctatggtgcggaagccggtccggaccgtgatctcatggtcctcaaaccggattctgatccggtataggtaaggggtctccgcagtccacggatgcaccgttccggcttcggctgtgattcttatctccttctggtctccggaggaggtaaaatccccctctgccatcagaagttccccgtcaagcaggctccaggttccgcttccggctccctttaccgtcaggtcgatggcggcccggccgcattcgcaggccgtgtccagaaccgccgtcacgcggcagtccaggaccgccttcctgggctcattaatcagttccacatccctgtaaattccggaaaaccaccacatatcctggtcctccagatacgttccgtccgaccacttgtatacacggacagtgacgtcattttctcctggcttcaccagagaggtgacatcaaactctgcgggcagacggctcaccttgctgtaaccggcgtggacgccattaacccagatgtcacaggcgctgtccaccccgtggaatttgagaatcgtatctcccgcaagccaggcgtcgtccagaacaaagcttctcttatagatgcctgtaggattcttcgacggtatgtatgggggattgaccgggaataagtacaggacatccgtatagtgcatatgatcgtatccccgcatctgccatacggaggggacatcgatggtatcccagcccgccccgcttcccggctcttcaaatccagccggagaaaattccggcgcttccagatacagaaatctccagtcgccgtttaagctcacatgtctggcagaatccccataaaatgaggttctggctccgcgtcttccgattcctgtgattgtctcatcttcccatcgtttctttttacgtctttccatagttgtctcctattatttaatcgctccgctcgttccctccacgatgtgtttctgtgcaaagaggaacacaatgatcgggggcagaatcatgatgactgtgatacagagcatcggtatgatctttgtgctgtgaacacccttaaaggatgccagcccgagagccagggtgaatttactcctgtcctgtaagaaaatgagtggcccaaggtagtcgttccacacggtgatcatgttcaaaacgccgactaagattaactgcggcttcatgatcggcataaaaatccgccagtaaatctggaatgcattggcgccgtcaattctggccgcctcctcaaagtccttcggcactcccatcaggaactgcctcatcaggaaaatatagtaggcagaaccgaaccaggccggtacaatcagcggctttaaggtgttgatccatccaaatatcttgaattccatatactgcgggatcatcgtcacatcccaggggatcatcatggtggacagcagaatcatgaacaggacatttttgcctttgaaattatatcttgcaaagccataggccaccagcgaacaggagataatctgtcccgccgtagttccgaccgttaccacaatggaattccagaggtaacgtccgaagggctgtgcgttccatgcgtttaagtagttttccaccagccatttcttcgggaacatcttaggcggataggcgatggcttccgcttccgtcttaaatgtggtaaacagcatatagacgaacggtgacaggaaatagagggccataatggtcaaaagcacgtagatgatgatctttgattttttcgacatactcataattacttcctgcctttcttggtcttcttcctggaattcttggcctcggtctcatagaatacccatgcagaggaggacttgaatacgagggctgtcaggaacaggataatgacaaacatcacccatgcgttggcacttgcgtatcccagcttgtggtgcttgaacgcgttgttgtaggtaaacatcccgtagaaatatgtagattttaacggtccgccgtttgtgagcagcatgacgagtgtcagctgctggaatgagctgattaacgatgtaatcaagttaaacagaatcgtcggcgtgataatcggcaatgtgatggaaaagaactgtctcgccgggctggcgccgtccagggaagcagcctcatataaatcgatgggaatgctcttgatatccgtatagaatatcagcatcatggtccccacgccgaacgcgctcgccagaataacggccagaagcgcccaggaaggatccaccagccagttggggccttcgattcccagcagggagagcagatagtttaacacgccgtagttgccgtttaaaatccatccccagatgatggagatggcaacgccggatacgactgcggggatatagaaaatggttctgtaaattttgacaccctttaccggctgcgtgatcagcatggccaggaacagggcgataatcatgttaaggggtacgaagattgcggcatattttaatgtgatgaccagagatttgtaaaactgtttatcctttgtaaacatttccacataattccccagtccccggaacgtcggcgtcgatgtgatcggccagtcaaagaagctcatcaccagcgacagtattaaggggcctgctgtaaagacgatgaacccgatgatccacggcaggatgaacagatagggagttgcctttctaaggaaacttttcttctccatgatttacctccatttaagttccccgcacagggtttgcctgctgcggggaatgtctgcagtttactgcatctcggataccgcctcattcagtacggcagccggatcttccatggtactcgggttatagacacgctcaaaggtcagatccagggtgtccttaagctcggaccagttgtctacaataaagcttgcaggtgtgtagccgctgctctgctccagcatggagtaaaatggagcgttggccggatcgtccaggatcttctcggactctacgacagactttaaagccggaagctcatagccgattctcgccttgttcatctcctcgcctgtccagtatttcacaaactcccaggcggcgtctttgttcttggaatcctttgaaatcgatacgcctgaggagcttaagatgctgacagaatcatggcccgctcccgcaaatgccggaatatcgacgataccgtagtttaagccgtcctcattaaaggcggcaatcgaccatgcgccgtagatatacatggctgtctggccgcttctgaactcgtctgtaccgtttttctccgtagccaccccgtatccgtccttttccatgttctggaacatggagacagcgtcaactgccttgtcggagtttaaatttccatcgaggtttccgtccttatccacaaacgcggttccgttgctccataaatacatctcataatcgtacggatccggcttcatctggaaggaaaagcccttcacgccgtccaccttctcggtgatcgtcttcgctgccgccatcagatcgtcccatgtccagtcattggtcggttcagcgactcccgcctgtgcgaaaatatccttattataaaacagcgcgtgtgtggtaaagcctaccggaatgccatagaccgaatctcccttggagttatatggccataacgcgtcgtagtagttgtccttataatctgcgccctctttttctatgtaggaatccagcggttccaggccttcatagtaggacgggtaatcccacatgtagagcacgtccggcgtatctcccgatcccatgccggcactaatctttgtatcatactcacttccgtaagcttccagcgagacctcgatgtcgtcatggctggcgttaaactggtctaccagcgcctgctgcttatccagatcctctgcattgtcccacgatgcaaaacggatctttaccttgccgccgtttgcctggctgtcagcctttgccccacacccgctcagtactgtcacagccgccacagaaagagccgcaatcaccgcaattgtctttttcatataattatttcctccttaacttttggtaaatacatcgtaacacacattagtaaaatattcaatattttactaagtaaaaatcacattttcaatattatgcatgattttactgccttgtttttgtgcatttatcataataaaattgactattttttaaccaaatgtgcctacgattatatttcccgcttttaatctagtaaaattttaccgtttttatcacaataatattatttttttactgccgcactccccgttgaagattttcaaatcattggattcggcaacgagcggtcgttaattatgctgtttaacaagctgcagcctttctccaccggttaaatatataatggaattatgacaggaattgggcgtggtttcagaagaagtaaaaataaaattaccacggaagaggatttaagatatgatgtaagaagaaaaagccggctcccgtctgccataaaaatgaccgtgagcagcggacactcccattctgtgtccgacactcccggtcatttttatgtatattcgggtaacgaaacgtttcggtgggccgtaagcggtaatcctaagacggcctcacatatcatcagaatctctgattaccttatttcaatccaccttctgagtccagaatacaaaacccagaatggcacagcagctatgctaccattttaaatcttcctctcgagtatctgtacctcatatccattaagcttccctgcctcttcgccatagaccagccgataggaggaatccacggagtaagtcctctcccggtctgtatgattcatagcaaagatccatctgcgatcagctttttctctggcggcaagctctacaccttcatccgcatttcccaacgctgcgatccctgctgcatctgtcatataccggaccagggccgccatgaacgcctcgtcaggctccgttccgatgtagtaacagcagccctgtccgtattcattcttagtaacgcaaggctctcccgcataaaattcactgccatagactgcaaggacctccgctccctccttcacggttatgatgtcacaccagtttcgggctgtgtggctttcattttgaaagaccgccgatactcttgcatctcttaagcagtcataatccaatacctccgagcccgtaagctcagacagccgtcccggaagctcccggtcagtcatacagatattggtctcatccttcactccggttcgcatggtaaggactaaatggccgccgtttttcacataacggaagtaacgttcctccagttcggaattcatcagatactgaagcggcgcgacaagcagcttatatttgccgaaatccccgtcatccggcacgaaatccaccggaatctgtctgtcgtaaaatgccctgtagtactcctgaatctgctcagtataagacatattgggattctgcggctgaatctgaagggcgtaattctgccggaacgaatatacgatgccgacttccggagcgggcatggagccctccatcttttccatcaatggagccgccttccgtatcatctccttcagctcgtaatatctgcggccgggattaccgctgtgaggcagaattccgtgccagtactgctccgtccccattgcgcagactctccagcggaaatacaccaccgcatcggctccgtgagccaccgactggagggaccacagggaaagctgccccggcgccggcgcacgccccatcacttcccagccggtgattcctgactgctgctccatgatccagaagtttttatttttgtagcttcttaccacatccagggtggaggccaggatatcgccgcgtccatgggactcatcggcgaaaaatccgccgggatactggtcatgactgacaaaatccagttcttttcccaaatcatagtagtccaccttatcggcaaagcccatataattgtgggtaataaaatggttcgggcagtgtttgcggataatatcggtctgctccttcatgaaatccacaatcaagtcagaacagaagcatttccagtccagcatagcggatgggttttcacctgtcactgtaatcctcggtgtaaatacttccgaaaattcattgtactcctggctccagaaggcattgccccaggcttcattcaagcggtccacagtaccgtatttcttttcgagccatccctggaagttcttccggcagctttcgcacatacacaaatcatgatggctgtttcccagctcattgtccggctgccatccgatgacattcggattatctttataatgaacggccatagcagtcacaattttccgcacaaacccacggtatacggcattggactggcagtcatggtgacgccccccaaagcctcttacccgcccctcccggtccaccggaagaatctcaggatagcggtttgccatccaggcaggcggagcagccgtaggcgttcccacaatcgtcctgattccgtagcggcccagcaggtcgatggcatcgtccagccatgcaaagtcatactttccttcctgcggttccagcttgtgccaggaaaattcagccattcggactaccgtaagccccatctccttcatcagttcagcatcggtctcccaccgatctctctgccagtgttccgggtaataatcaactccaaaatgaatgcccatagtatttagtctcctttatgtataattaaacttatcttattttttatgctgcacctactcttttaccgctcccgacgtcagccctgacataaagaactttgacgcacacaggaaagccgccagcaaaggcaaaaccgcgcaggtactggcaagcataatcgcgccgtagtcattacctcggtcagagaccatagatttcaaagccaggggcaatgtctgcatgcttggtttacggagtatcagcaaaggctgcataaagtcattccatgtatttacaaactgcataatcccgagagccgaatacgcaggaatcagtatcgggcttataaccctgaagaaaatcgtccactcgctgcatccatcaatcttagccgcttctctaagggagatcgggacattgttctgacaatactggcgcatccagaaaataccaaacgcattggcacagttcggaataataagtgcctgatagctattgatccagccgaatttcgacatcatcataaaccatggtataataccggcggtaaacggaatcatcatcgttcccagcagaatggcaaacagcttgttctttcccggaaaatcatacgttgcaaacgcataaccgcccatagaacaaaacagcaggcagagaaatgtataggaaatcgaaatgatacagctattgataaatgcctttacaatatcgatctgccccatcatggtatgaaaattcttcaccagactgctgccgaaccagatatgaggcggaaaagaataaatttcgttggtcgtgaggctggacataacaaacatcatataaaatgggagcagcataatcagcgcaatcagccccaataccagatacagaattgcttttctcacatacttcatcgtttatctcctcctcttcaccggctgcctgtccttggacatcttgttaaagattacggaaaacagtacaatgaacactgtaatcacataggcaacagccgacgcatagccataagctgtacctccctgaggcgctttattaagcagatacatcatcagtgtaaggccgccattgttgattccccctgtccagctggaattcgtcagaataaatggttccgtaaagaggttaaacattcctatggtggattggatcaatgtgaaaattataatcggtttaagcagtggaatcgtaattttggagattgtctgtatatggcttgccccatcgattctggatgcctcatagatgtcatggctgatcccctgcatccccgcgaggtagataaccatgttccagccaatccacttccatgcaaacataacgattactgccactttaatgagcgatccgtcacctcccagccagttcaccttaccaaacccgaaaaagcttccaataaagttaatcagtccgtagttattactaaaaagctgcataaatataattgaaattgcaacggaactggtaaccatgggcataaagtaaatcgtcttaaaaatgttctctccccgaatcagctttgcattcaggatataggccagcaccagtcctccaaataaaataggaatatgagcaataattccaatgaccagcgtatttctaagcgccttccaaaacagcacgtccttaaataagttcaagtaattttctaacccgataaaatgcatagctgacattccatcccatcggaagaaactgagcccgaagcccatggcgatcggaaacaaactaaatatcgcaaacagcataaaaaatggtgctatgtacacgtatgcgactctgttttcatagaggacttttaagaatccttttctccctcttccctttttccccatcggtgcccctccttctattcattccataaaccggcatccttatatacctggatctgctgatttttaagctctgcggtagcatcttcgatatcttttgcgagaagatccttgatcccctgagcatcaaggccctgattaagaccggcattaacggaattgtagatacacccctcggccgttacatccataatagtattaaatacaggttccagatcctcggagatggaggcccagagtgcttttgtcttctgtccgccaaaatatggatcttctgcgtcatagatcgccgtgttgtcataggcaggcgtatatgcgggaaaataatcaactgcttccagcatctcattctgcggttccgcgttgcagagcatgtactcaataaacgcccacgccgcttctttattcttgctctgttccggaattacaaggaaagaaccgccccagttacagtgaggaattccacctggcagttcggcaactccccaatgtccggtgccgtccggatcaatatctgtttttaaaaatccaccaaaccagcctccggttgccacagaaacacaagcgccgcttgcataggccgcataagcctccgtgctccacatatccacgttcatatccagttgatccgctcttaaatcgataatcgcatttaagcagtcaagatcaccctcgcgatccagtttcaaattcattttctcatcatagtaatccctgttacagtacatcagctgatagaagtaggctgcattgggaacgagccatctctcccccggcttattgacggcttttgcagctttcaaaacgccatcccaggtactcataagttctgccacctcagccgggtcggtaggaagtccacattcttcaaacacatcagtgcggtagaaatacgtgcaaggtccaacatcccatggtactgcaacaaattgggacttatcaacagaatacgcctgatcccattttaaagcaacaaaatcatttttatatttttccgcgttgaaaggctcgtccaaaagattggtaagagctttggaatcgcggtactgggcaatgtaagcgccttcaaccatcgccacatcaggagcccctgagcctgctgccagggaggtagccagggattggtggtggctggttgtatcggtaaactggaattccacttcaatatttggatatttatcatgaaatccattcagagctgctttaaagccatcatctccagaaggccagccacccacgatgatagatccctttaagtccgccggatctgcgggcatactggcagtctgctggccatcacccgacaccgttgtcttgtcactaccggtatttgatgatgatgtgccgcaggcagtcaaagacaatgccataaccgcagccatggtcagcgccaaatttctctgtagtccgttctttttcatagtttaaattcctcctttaaatttataaatcataattattgagttacaatttttttaccgaatccccctcgctcagatgcggtttgaaggagttaaaatagtttactctacgcccctcaatcatatccagcaaggtactgacgcagcactcagcctgctccctgatatttaaagacacagaagaaagaaacggtgtcacatactttctgttttcaatgccgtcaatgccgagaattgatatatcatcaggaaccttgatattcagttgttcaaagcgcctcagcatacccatagcaaattcatcattaaagcagaaaatggcagtcgcctcacattttcgttcaaggaaccggtcagcacagctcattccttcctcgaaaaaatcctctctggcaaaagctggtctcgtatttccaatattgtcgattatgtaatccctgaatcgttttccataaacaggcttcatcagattactgaatgccacatgtctcggatgtaaacggctgtcataaaagaaatcatacatcgtagcaaaggcaatctttttatgccccatctctcttagataggcaagtccaatctccacagcatcgtacgtatctacatccacatatggaatcctttttaaatttttgacaggtactccgtaggaggcggtaacaatcggcatataaaactgttctcctaaaaatgcctgtacctcctctgccacattgtcgttctctactatcattccatccatcagcatggtttttacccgttccacactgaaattagaaaagtagaacaacgtgtacccgcggtccatggcataatcggacattttattgaacagctctgtataaaaggaattgtagatatccgaaccaaaaaagcacagctgataagtctgtctgtttttcagggaattgctcaggggattcggcctgtagcccagttcctccaccgctttatagatcgcttccttcttgtcctttgaaacatatcctctgccgttcattgttctggaaaccgcactgaccgatacgccggccctttttgctacatcttctcttgtaatcaccggattatctcctccttactcattattctaaagaatccggcatttatttcaatgttttcttatgtgcacagatgagtcatagtgcatattctactattttatatgactcacgcgaagcatatttcttgtctttttgttggttgtttttatattttgcacaaagcttatagaactatttttaaatattttttaacttgtactgtaaacaggccataccgggtttcacttgtatgtctatgattttatcaaaaaagcatacggaacgacgccggccaaataccggcagaacgtcctgaaataacgaaagcaaaaaaacaaaaagcgaaaagaaagagcccgcagcctccgtataaccggcggctgcgggctctcctgtctcttttccaatctaaatcagcatcccttccgtcctcacattctttaaatactgactcggagtgatggaagtgaccttcttgaacattctgcaaaagtaattgctgtcgttatagcctaccagataggcgacctcagtgatgctccggttttcctggcttaaataatactgagccagcttgatccggtggaaattaataaactccgtaaccgaaaatcccgtttcgttcttaaatttccgggacagggaggagacatttagaaagaacagctccgccagctggttcactgtgagttcagagggcagatgctccagaatataggtggtaatctcctgcaccttggcgctgtattgggccgtggagcagtcccggaccgccagacagtaatcgctgaacatcatgggcgtcaccttcttatggagaaattctacggaggaagagccttcgatcagcaggccatatttataggaaatgctccctacgataaaggcagacacacctctgacggttaccgattccctgtccaccgggctgttctgggtcggcatcctgctgtacttcggaatccccatgctgggctggatcgccacgctgatttccatgaaattctatcctctggatgataaaaagatggtggaaatccagagcgagatcgcaagaattaaggcagaagcctgataaaccaaaaaagaacgctgtgctgtccctttcctcggacagcacagcgtttttttcttctatcagccttcatacagattcgcagccttctttaccagccgttccagaagcttctgcatatttccgatcaccgggtgatctcccaggctgtattcctccgccactggtttcatcttaggaaatgccagccaggtgcttcccgcctcatcttcccatactgcgatcttaagaggaagctccagcgcgatgctctggtccgcctgcatgagtccggttccaaccttcggcgctccgaatacaagaaccgttgtcggtctcagttccaatcctgcctccgccgcgttccttgcatgatcgaatttggcaaacaccggaatatcaagtgcgtttaactgcttctccagcctgctcaccgtctcatctgccgagaactggccttccatcaggaacagccgcgtatcatcgtaattggtggacaggagatctccgaaggcgccggcgatctttcttcccagattcgtgaaatccacgccctccttgtttgccatcagggtgacgcataccagctcctccggatgggtaaagcggcttaagaaagaggaaaatccgggtacggagcctttaatatccatcaggcctctgtgatggtagaactgccatccagcgctgcccggaacggtccgtccatcgggaagcgtccatgacgcatagacaaccgccctgtcttccggctttttgatcaggacaccgccagcaagaccaatatcccagaaggagatatcctgcgccgacgcccacacgtccccaaaaccgcggaaagcggaggaatgcatctgcggaaacgcacttccgtcgctctggtagctgacagccgtctccgccggatcaatataccggccgtcggtcttgaaaatctggtgaacgtattcactcaaggataaatcctcctgatgaaatgctgagagaccatccgaaaacgatgtatgcttaagcccaaggagttcaaactgattcttcttgacgaattcctgatacgccattttgctcactctctcgaccacttcggtcagaaggaggaaattcgttgcactctgagccacctctgttccgggttcaaactgaagaggcagatctgcagtcagaccgatcagttcttcaaacgtccactctctcgtaaggctgaatccctcctgcttcctgtaatccgcaagccccgaagcgtgatgaagcaattgacgaaccgtaatgctcttccactgttccgggagtgaatccacatacgctgcggcaggcgcgtccaaatccacgcttccgtcctcgtacagctgcatgaccgccactgccgcatatccctgggaaatagggcctgccggccaaagtgtattcaccgatgcaagacgcttctgaccggcatctgaaaatccgtatcccacaacccgcggaatatagggcgcctgaacaatcgccagggtcagtcccgggatctcctgttcctccataaactcccataccatctcatccacggttcttccaagatacgatacatccgcgctgcccctcatcttcatctctgtatgttctcttgtgttcatactgaatactcctttcgttttggaccggtcgcctctcgtttcacgtactggcaatcctgccagctcactatggtgagctctgtggccgtatacttagacttgttttgctgttgttactgctgtcactactgttataattcaagttacagtttatactgtaataatacatgttacagtataaactgtcaacagttttttatattttattgattaaaagaatagaaaacgtattacgtcacaactccttaccgcacgtttttggaaagtctggctccattttggacaccacaggcattacaaaacagcttgtccggttacttcattccgtcattttcattttcgtttcgccaccataatttataaagagcaaatatagaaagcgcagccaaattatgctgtcacctcaatcattatcagataagtagtataggacagctaaaatccagacacagagtaaaatcacagccaccagaagatttgtcagccattcgttcatcgttccgcacctcacctcgatataagaaacggagcaccgtctccggtactccgtttcccatcatgcgcacaaaactgcgcattctcttttatgcattaaataataaccttcaccggacatttcgccgcgcactttccacagttggtacacttctcgtagtcgatgaccgccacattattatccatgtggatcgcatcaaactcgcactgcttcgtacataaggtacaggcgatacagcctgattcacattttgcctttacatctttgcccttgtcatgggagttacactgaacgaggtgctccgccgtatacggcacgagctcgatcagatggttcggacaggaggccacacatttgccgcaggccacacatttctccttatcgacaacagccacaccgtcaaccacgtgaatcgcgtcgaaggcacaggccttgacacaggaaccgtatcccatacagccatagatgcaggctttctctccggcacccggaacgactgtgatcttcttgcagtcatccatgccgtagtagttgtactggaccttcgtcttatcgcaggtacccttacattttacaaaagccactttcttcacagcgtttccgccgtccacgcccatgatggcgccgattctgcccgcaacagccgctccgcctaccggacaggcatccacggatgcgtcacccgcagcgattgcctttgccagagcgtcacagcctgcgtatccgcagccgccgcagttattgcctggcagctcgttgcgcacgaggatctctttttcatctgtttctactttaaatttttcgctggctacacctaagaagacaccaattaaaataccgaggatacctactacggctgccgctatgataatacctgttatcattttcgtctcctccccctaaattaatccggaaaatccgaaaaacgcgattgccatcagtcccgcggtgatgagcacgatcggcgatccctggaaggaatacggaacatcgttatgctcgatcttctcgcgcacaccagccagcattacgatggcgatggtaaatccaacggaagtacccacgccgttgataacgctctctaatatgctgtaagacttctgtacgttggttaatgccacaccgagtacggcacagttggtcgtaatcagaggcaggtacacgcccagcgcctcataaagcggcggcatggacttctttaagaacatctccacaaactgaacgagtgcggcgatgaccaggataaacacgatggtctgtaagaattccaggtttaaattcaccagaattcccttatagatcacgctggttacaaacgatgcaatggttattacgaaaataacggctgcgcccataccggcagaagtttttacgttcttggaaacgccaaggaatggacataaaccgaggaactggcttaagactacgttattcacgagtgctgagccgaccgcgattaaaaacaattctttcatctatccatcctcctattcttcttttttcgaggtagcggcctttaattccgcttccttcttagccaggtcggccttcttcgatgccagggcatcctcctctgcctgtctctttcttgtctccagaatctcatggttggacatacaggaagagccggaacagttcatacagtcgccgccgcatgccagtctggactggggaacggagccgttggtcgccgatggagccttgaacttattctggagcgctgttaagacagccagcacgaagaacgcgcccggagccagaataaagatggaaatatggaaatcctccggaataaacacctttccgaagaccgcgcctgcgcccagaatctcacgcacaaggccgattgctgtaagggcaatggtaaaaccaagacccataccgattccgtcgaaggtagaagccatcaccgggttcttggatgcataggactctgcacggccaaggatgatacagtttaccacgattaacgggatatagataccgagagccgcatttaagctgggcacataggcctgtaaaagcagctgcacgatggtaacaagggttgccacgatgacgatgtacgcaggaatcctgacacggtcgggaataatcttgcggagcgccgcgatgagcatattggaaaacatcaaaaccacggttgtggaaagtcccatacctaatccgttgatggccgaagtcgtaacagccagcgtcggacacatgcccagcatcaggacgaaggtagggttctcttttacgatgccgttatataaacgttctgtacatttattcatgatcccacctcctattgcggtatgcagttagctgcgaagtaaagagccgcatctactgcatgagtcactgcgtttgaagtaatggtcgcaccgctgatcgcgttgatctcggaatcggaagtgctgcctgtcttcgtcacagtaaattcttctactgacttatctttatactgatccttgaacgcaggctctgacgccttcattccaagtcccggtgtatcactgatttccaggagctccacgccggtgatctgtccttcattggtgataccgacggaaaccttgacggttccgccgtagctgtcgtcggaggaggccgttatgatgtgtccgatcacattgccggaagcatccactgcctttaaggccacgctcaccgcgacattgccgtactcaggcttctgctcctttaaggtttctttggatacagccacctgatcctggatcgcctgatcaaatacaaaatccaccgcatccggataggcaatctgatacttatggagactctctttcgcctcggccatctggatcgggaccttggtaatctgatagacagcgcccagaagcagaccggaaatcaaggtaattgcaaataaaatccatgcgtctttcatgaatccgccttttttcatcttacttgccctcctttccaaacgcctttggaagggtaatcttctcaatcagcggcaccagaatgttgctgatgatgatcgcataggaaacgccctctgcggatccgccgaacaaccggaaaaggccggtcagcacacctaagagaataccgaacaggatctggcccttcggtgtaatcgggctggttacatagtcggtagccatgaagaacgcaccgaagatgaggccgccgccgcataagtgtgcaagcacatacatgagatcatgctggccgaaaataaacacaaacactgcaaaggtgattaagtaggccgccggaatccggatggtgatgaccttcttgatcagtaagtaagctgcgccgatcagcagggcgatcacggatacctcgccgatggttcccggaatcttgccgatgaacatggccggaatatccactgcctggcctgcctttaaggctgcaagcggtgtcgggcttactaccgcgtcgttatatgtgaaggtagtcatcttgcccgcaaatgcgatgagtaagaaacatctggccgccagagccgggttcataaagttctggccaaggccgccgtataactgctttacaacaataacagcaaagataccgcccagtaccggaatccataacgggatgcttggcggcatgttgagcgccaggatcatacccgttaccagggcgcttccgtcgctgatcgtgactggttttcccataagtgtctcgtacacatattcgctgagcacacaggaaaggactgtcacaagaatgacaagtgctgcttttattccgaactgatatacaccatacgcagtcgcaggaatcatggcaatcgcaacatccagcatgatattactcgttgttacctggtccctggcatgaggtgatgatgatacgtttaataatttactcattcttcaccctcctacgctttctttctgcttgccgcaactactttacgcatttccttgaaggcctgggttaaaggtctcttcgcagggcacacatacgtacagcagccgcattcgcagcattccataccatttaatgcggtaaaacgttcgatatcggagcgttccgccgcgtccatcatcatctggggaaccacatggctcggacagacgcttacgcatcttccacagcggatacaggcggaaggagcatgaatcgccacctcgtccttcgtcatagctgtaagcgcagaagaggtcttcgtcaccggaatctctaaattgaacagtgcctgtcccatcatcggtccgccggaaatgattttttccggttctgtcttaaagccgccggaagcctctaaaagttccttatagctggtacctgtccgcacactgtagttctgcggatttgcaatcgcgtctcccgttaccgtgataattctgcggatcagcggagttgtcttgcagactgcattataaatggaaataaccgtatccacgttgtccacgatacagccggcgtctgccggaagcatggaggagttgatctttctgcccgtaaccgcgtaaattaaggaacgctcaccgccctgcgggtacttcgtaagaagcgggcacacggtgattctcggttcgtccttaacgagctccgtcatcttctgaatggcgtcaggcttgttgttctcgataccgattacccccttggcgttatcgaacagctggaggatgacattcagtcccttgatgatgcttaagggttcttccagcatcatgcggtaatcggacgtcagataaggctcacactccgcgccgtttacgatgatcgtatcaatggcggattcgtccttcggcgtcagttttacatgagtcgggaaacctgcgcctcccaagcctacgatgccggcctcttttacgatattacggatctcttctttggataaggtctttggatcacgatcttcgccaaagccttccaccgtctcatacataccatcattttccacaatgatggacggcaccatggcgccgtttgcaaccattctcggttccagagacttcactgttccggaaacggagctgatgatgcaggccgatataaatccgcccggctcaccgatcttctgtccaaccaatacatggtcgccctttgccacaagtggcttagccggcgcgccaatatgctgggacagcgggaaaaccatctcgccttttggctgcagtaccgatactggtttactcatcgacagttccttaccctcgtacgggtggatgccgcctttaaatgtagccaaacccatctaactaaccctctttctatacattcttaatctctcccggcaaaatatgacaatcgcatttttgccatctcgtacagtataacataattcaggaatcgaaacaattgaaacttacacattgtatactgtgttctttatggaaattcttccatttatcagataaatatagggatggaacacaagaattccttgttaaaaatgtgacgaaacttattaacccaggttatgtcttgtatttatataaatacaattatcttaaaatatttctgctgcagtgccgccgatcccctttttatttgataaatcgattctgctgccgaagtttccattgtgaaatttttattcaattcccctgtctgatccccgcttcagggaggataatctaataaatttttaggtctttaaggtggctatatattagaaaatttaataaatacaccactatcttacagaggaaagcagctcagccaccttatctctcgccaccgcctcaaagcaggctgcgtgctgggaatccgcgtaggagtaggacacttcctctcccaccgtggttgggtcggcgatccagtccttgcaggaactgtggacctgcgcaatgccggttttctccgtcagctctttcgcgttgcccgcgttgatgccgctgcctgcgagtatctcaatcctgtctccaaaacgatcctggagttcttttaacagctgccagccatcgggagccttgcttttcagtccgctggtcagaatccggtccacgcccagtgaaatcagctgctccgcggcctcaaacggattctttacacagtcaaatgcacggtgaaacactgcttctccgcccttttcccggatggccttcaccataagctccgtctgagataaatcgatggttccgtccgccttcaggcagccgaatgcgattccatccgctccgtgtcccatcatcatctggcagtcaaaaaacatctgtttgaagtccgataccccataacagaaaccggcgcctctcggtctcgccatggcgatgacttttaggggtgtttcccgttttaccagcagaagttcagccatggaaggggtcagccctcccagtgccagcgcactgtttaattcgattctctccgcgccgccggctgccgcctccagcgcatcataataactcccgcagcagatttctaccgtaatttgtcccattttttccttcctttctccatttcagccgccgaaaataagcacgcatttttcaagaaaacgcgtgcctccgccttccggctcatgcacggcacacagggacagtatatcagtttgaaaataccatgtcaatttttgatgggggggtgtggattgaagaaacgtggacttttgcgtagggtatcgaggaaaagggcgcgcgggaggcagggagagaaaggttcagggattccgagggggtgggactaagggagaatacccccctccgcaggggtcccgggcaattcgaccgaacgcctgatgcgttcgctctcagtgcccgcaaaatcgcgtcctgaaaacgcgattttgcccctgctccggcggctattctccctaagtcccaccgacctctgcatcattcacctttctctccctgcctcccgcactcccttttccggccaggttgtgaaaaagtccactggcacttggctccacaaggaatggaggaacataaatggacttccgtcggggaactgagaacgctggaaaagactattgttttttaacttaaggagccaatacacagccaaagagcctgaggagagcaggagggggacgggggcaaacgaacaaaagggttccttttccgaggttcgcaggaagttaagcagaaagacaggaaaaaagggtggtgaaatctggcctccaagccagatttcaagtggacacggaggagaagtccttcaggagttctccgtagtttgcacgatccgcccttttttcctgtctttctgctttacttcctgccaccgaggaaacaagaacccttttgttcgtctgcccccgtccccctcctgctctcctcaggctctttggcgtagcattctcccccccccccactattttgtcaggatccgcatcgatccgtcatttgccgtcatagcgatgtttttgtccgccccgttattctctcttaaatctttttcgctcgtattcctgccgtttaagttaatatctccgtacttcatcatgagatcaaaattataatccttctcggcgcctgtgagctccagagtgatgtcaccatacttgttttcaaagtctccgttctttatatcagccattctgatatcacaggacccgtctgactgcttcatggtcatcgaatccgaaactattgcgctgcccttgatgcttccatatttgttggtcacggttatattcctggacacgatatcctttaatacaatctgactgtcggaggcatcaatatccaggcggtcagcctcaatactatttaaatccgtttctccatacttgttgatgatatcgagagaagtaaacgtaccgctgtcacagtaaatggccccgtcggaagcggtaaagtaagccgtctcggcctttatgccacttaaatcgatgctgccgtatttcgatgtgatatccagtgttttggtatccggtccgtcgtagattacgctgctgtcgctggtatagagttttactgcatccatgggagtgtccttcggcacgtaaatcgttacgctgccatcctcccggtcgtgtacatagctgccctctatcaccaggaaaccggccgatccccaggtctcgctgttagtcggttccgggacacaggtaaagctcaggattccattctttattgtgtattcaggctccttatttcttatatagagatggtattccaggtagtaggaatcatcttctgacggctttatcttaataccgttatagttcacccggacatccatggaggtgaacgggtcaatctttgttttctcaagctcaaccagcttttcagcatttaaattccgcgcctgctggttggtatacatcccattccggccgatccagaagcccggctctccgcccatggcatatccggccagagacagtcccagaccagccacgatgcagacacccgcaacagccatggtaaccttcatgattttcttcattttttgtcccccctcgtcagcagtctttttgtaaaaccggccatgccctggtaaatatacttacagcttgcacatccagcgcagatcagaagcagtcccactcccgattctcccagtgccgttccgagtatgaagattccgctggccagctgagacggaatgaaatagaaacctgccacgatactcacgattccaacagccacaaatactactccgctgaggaaaagcgcaacgaaaatggaaaagaccataagcaccatggccaggccgaagaccacaacgagcagcaggaggggcagtccgatgggagccgcacacagtgccagaagcacgatccagagcgtggacaatcctttcctggcggcccgttccggcttgggctcctccagacgcttgagggccagttcctttacgatctgagccgcactctcctttgcgtcacccagctcctctatgacttccgcttcccgttcaggtcccgcatcatcaaaatattcgttataataggaaagagcttcctcccgttccgccttcggaagacgcctaagcgccagctccagctctttcatatactcattcctgctcatcttcttcacctccaacgagaatttcgtcagccgcagtcttaaactcatcccactctttccggtagaataaaagctgccctctgcccgcctctgtaatcttataatatcttctgtttcttccctggtactcctggtcatacgtctccagaaaccccgcctccaaaagtctctttaaaaccgggtacagggagggctccttctgactcgctatgttccttagccgctgggcgatcatgtagccgtaggcatcttctccctctgcgatcgccagtaccatggcgtccaacagcgtcggcgtcaattgatacaccataccgtcctacctcctctcattatttctgatcaattatttctgatcagccgatttttaatcacatttatgtgttttatatatatgctttatatacatatattatattccatataatatataatgtcaacggatatatctaataataaactatgctttttcttaagtaattcttaatcatataaaggaggcacgatttcagaatggcggtatcttgagagcggcggcgggccttacggcaaagaaaaagcaggcggtacacggctgttaatcagccgcgtatccgcctgcctgctattacatacttaacacacactgttcaaattgatttcgatctgacaatatctcatacggctctattcaccataagaggtaactgtgcaaagttatcgttaatccaattccttcactccagtatagagttcataataccggcccttctgagccagcagatcgtcgtgatccccgcgctcaatgatctctccgttttccagtaccataatggcattggcgttgcgcaccgtggaaaggcggtgggcgatgacaaatgtagttctgtctgccatcagacggtccataccgtgctcgatatgtttctctgtacgggtatcaactgagctggttgcctcatcgagaatcaggatcggcgccttggagatggccgctctggcaatatttaaaagctgcctctggccctggcttaggttcgctccgtcgccttccagcacggtgtcaaagccgtggggcagacgcatgataaaggaatacgccgaggccgtctttgccgcctggattacctcctcatcggtggcatccagtctgccgtaccggatattttccatgaccgtccccgtaaataaatgggtatcctgaagaaccatggcgatattctggcgcagattgtcgcggttgatatgacggatattgacaccgtcgatggtgatggagccactctgaatatcgtagaaccggttcagtaagttggtaatcgtcgtcttgcctgctcccgtggaacctacaaaggcgatcttctgccccggtttcgcatagaggctgatatccttcagaatcgtcttttccgggttatagccaaaggtaacatccttcagctccacatagcccttcattggattcagcaccgccgcgtcgccgtcatccaccggctccggctcctcatccataaccgcaaacacacgctccgcaccggccagcgccgagaaaacgttgctgatctgcatggagatctcattgatcggcctggagaactgtctggagaagtttaaaaatacggtgaggccgccgacgtcaaatcctctcagcacacagagcaggccgccgatcgccgccgtcagcgtgtagttcaactggcttaagttgctcataacaggccccatcatgccgccgaagaactgcgccttgatcatgttgtcacgtaaatcttcatttaaaatctcaaactcttcttccgcaatgtcctcatgacagaagaccttcacgaccttctggccgctgatcgtctcctcgatataaccgttgacggcgccgagggaggtctgctgtgcggagaaatacttctggctctttcctgccacataaccgcctgccttcatcatcagcggaatcataaagacggttaccagggtcagccagatgttggtgtaaatcatcagggccagcgtgccgactatgcttaaagcgcccgagaacagctgcacaagcgtgctgctcagcatctgtcccacggtatccacgtcgttggtaaaacggctcattaagtcaccgttgttgttcgtatcgtaaaaacgcaccggcagcttctgcatctttgtaaagagctcatccctgatcttctgcagcgcgttctgtgccacagtcagcatgaccctcgactgcgcgtagtttgcgactacgccgacgaagtagatagccgccatgaataccagggaagcggccagaccgccaacgcttccgcggcttccatccatgggagcgatatatttattgataattggtctcagcatataggaaccggttaaggtcgccaccgtattgacgataacacagaaaaatgccagccccatgtgaagcttatatccatttaagtaggacagcagccgtctgatagtctccctgctgtttttcggcattccgcccttaccgtgctgtcttccgtggcccggaccgcccatggggccgcgcctttttgccggggctacatttctgccgtagcgcctttttaaactctctacccgtttctgattatccattacgcgctcgcctccttctcccggtctctctgtgaataataaatctcctggtaagcttcgcaggatttaatcagttcttcgtgggttcccattcccacgatctttccgtcatccagaacaataatcttatccgcactctctacggaaccgattctctgggcgataataaactttgtcgtatcttttaatgtggtctggaagcactcgcggatctttgcctccgtagccgtatcgacagccgatgtgctgtcatccagaatcaggatcttcggcttctttaacagggcgcgcgcaatacagagcctctgcttctggccgccggagacgttgacgccgccctggcccaaatccatctcgtatccatccttaaaggatgtgacgaatccatctgcctgagcactctcggccactgcacggatctcttccatggtcgcgtcatcactgccccactgcaggttttctgcaatcgttccggagaacaggacatttttctgaagaaccatgccgacgccttctcttaaattccggatggaataatcccggacgtcgataccgtccaccagcacctggccgcggtccgcgtcatacagtctggggatcagctggacgagggacgtctttccgcttcccgtggaaccgatgataccgatggtctctcccggattggcggtaaaattaatatgatccagcaccatctcgtcggtgtccttcgcatactggaaacagacatctctaaattcaatccggccttccgtcacgacggcgtcctttcttgccgcgtgctcatccgttaagtcgatctccgtatccaggacttcccggacacgctttaacgacgccatggcacgggaggcctgtaagaacaccatggataccatcatgagggacatcagaatctgaacgatgtatgtggtaaatgcggtcaaatcaccgactggcatggagccgccgataattaagtttccgccgtaccagacgacggccagcgtcgtcacgttcatggccagcatcatgacaggcatggtcgcaattacgatcttcatggcccgcaggctgccttccttcaagtcttcgttggtccggcggaatttttcttcctcatagtcttcccggacaaaggatttgatgacgcgcacattggtaagtgcttcctgaacgccggagtttaaccggtcgatcttcttctgcatcacttcgaaccgcggaaacgccgtcttcaaaatgatggcaatcgcgatcagcagaagcggaatcacgaccagaagaatcgtcacaagcctgcggttcattaagtacgccataatcaggccgccgatcagcatgccgggcgcgcggaacatcatacgaaggctcatcatcagcacattctgaatctgctgaatatcattggtcagcctggttacaagggaaccgctgctgaaatcgtctatgttcttaaaggaaaactgctgtaccttgtcaaatacgtcttttctcaaatctgagctgaaacagatggaggcctttgatgagaaataggccgctccgattccgcctgcggccataacaaaggccgtaaccaccatcacgccgcccacggctatgatatagctggtgtccctgtttgccacaccattgttaataatcagtgacatcagctttggaagcatgatctcaccaaatacctctgtcagcatcaaaagcggtgccagcagaaatgagccccaatagggctttatatatttccagtatcgcttcacgttatgaatcctccttttttgtcgttgtcttagtcgttatgtcggacaaattcgcataaatgcgctccagatacccttccatggcctgaaactcttcctccgtgaatcccagaaacatctgattttccacgtttttaaaaaactgccggctgtgttccacgacatcgagcccttcctctgtcagacagagcttgttgtaccggttgtcttcctggtccacaattctcgtgatataaccgcccttttccagttttttcaccgacaccgctatggttgccgcggtgacgtttaaatattccgcgatttccttctgggacgcgttggaatgttccgccagggtcgttaaaatctgatgctggctcctgtagactcctgtcttattcagccgctgctccagaatgctccggtgcagcttcataattctgatgtactgcgtcagcacgtgatgagccgaagaatccagccacttgctgtcatggcatggcccgctgccacaagatttcatgtttttccgcctcccttcctcatcatatggggaataattagttatgtgatagttagctaattaataattaggtattatactctttctcaataaggattacaatagggtaattatgaaatttctgtgaaatatagaaaaaaaagaggccaaaaggccccttcctgtcacgctccatgcatgatcataaatgtaaatatgtaggattataaagctgctgttacatttccagcgtaaccacggtccacctgctgttctgcattatgaggaagcagggccgcttcattttatagcgatagtagcgttccatacagtttacaaacaaacggtatctcatcaggcttgtacaaacaggataaattgtcatggttttccctcccatatcattctgttatagtttatgcgaaaaatgcgtctgttatgaccagatttacactgtattattgacttttcagacatatgctttataattactttatatgctcatttgggaggaaaaaagttgaataaaatatgtccttattgcggaagagtcgggaaattaggcacatcctgcgaaggctgcggctatgtccttcaggaaagtgataaatcggtaaatgcaccctccgtgcagccccaggcaagtccaccgctggtttcgcctatacggcctgatactgacaagctgaccaatcgtaaatctgaacctgtatctgccggacgtcccgtaaattctattctaagaaaaattgttataattatcgggtggatcatatcagcccctatctttttatttggcctgattggagcaatgactttgccggaggcatttaaaaacagcgcttcctatggatttctgactatcttaatggtttatttcatccttaacaccgcgctgctgattttccatattacacactttaaaccactgaaaggtaatcacgggaaatattttaaatattcttacattgcaaacgtgctcctgtttctcattgtggggtttgtatttttataaatcgtaatacaatacataggatacctgttgtttatatcaatagtgcagttctaaagtgttctaaaaaggacgatcccatatcgggtatcgtccttttccttatgcctctaaaataacacatttttctcagccggctttgtactggcgatcagcctgccttcccggtagcttaagagtacctcgctctgtttgttcagcgcctgatagaaatccgtctggttcagcacaataaagtcagccggatttcccaccttgattccataggtatctcccagattcagcgtccgcgccgcattatgggtgatcagcttatagctgtttaaaatctcctcgtatcccatcatctggcacacgtgaaggcccatgtggaccacgctcatcatattgccgtcgcccaggggataccagggatcgaagatatcgtcgtggcccatggaaacgttattgccgttggccagcagctccttcacccgggttacgccgcggcggcgcgggtaattgtcaaatcttccctgtaaatgggtgtttaccagaggattgctgacaaagttaatgtcgctcatcttaagcaggcggaacagtttgctgcaataggcattgttatagctgtgcatggccgtggtatggctggcggttacccggtcttttaatccgctttccagagcacggcaggccagaacctccagtcccttggactgctcgtcatcgatctcatcgcagtgtacatccaccaggcggtcgtagcgctccgccagttccatgcagtaatttacactctccacggcgtattccctggtaaattcaaaatgggggatcgcacccacacagtctgctcccatcttcaccgcattttccagcagctctttgccattcgggtagcttaggattccctcctgaggaaatgcgacgatctgaatggtcacatagtctctcagctcctctttcagttccagcatggcttccatggctgtaagcgatgggtctgtcacatccacatgggttcttacgtactgaacgccattggccgcctgcatctgcaccgccctccgggcgcgctccttgacgtcctgcctgctcagcttttccttccgcttcgaccagcactcaatcccctcgaacagggtgcccgacatattccacaccgggtccccggccgttaagcaggtatctaagtgaacgtggctttcgataaacggcggaaatgcagacttcccggtaccgtcgatcacttcctcacccggaagcggttccaatgcaggcgctatcgcttcaaatactccgttagacacgcggatatcagaagcctcttttccattttcaataaagatctgttttataagcataacggttctcctctcctatctagtactggatgtacgttttccaaaaatacggtcgatgatcacaaaaatcacagccgcaaccagcaaagaattcagcggcttaatcccccactggacaaagattcctacaagcgctccgccagccaccgctaaaatcccgcccggattcactgctgtatgcggataggactcgtccatataatcctttttgtggaagaagtaatggagaatgatcaccgcgccgacaggagggatcatcccgctcagcagatttaaaaaaccgacgaaattatagtagagccagacagccgtcgccgttcctacaagacctcccgctaaaaccatgggcttcatgggaaccttggtaatattggatactccgaggccggctgtgtaaagcgcgttattgttggtcgtccagatgttcagtcccagcgtaataatcgccggaaccgccagtccctgtaaaatcagaatattaaagatatccgcaactcccgtaacagcgccgccaacggctccaaatatcatcatgatggaatttcctacgaagaaagctaccaccgtcgccgtgaccgcagtcttcggcgtcctggaaaatctggtgaagtttggcgtcgccgttcctcccgagataaaagatccaaccacgatggcaatgccagccgccagcgaaatcggattctccgggttctgtgcgaagacattcgcaaaaccgtgaacctccctgacaccccagctgacagaataaatacccagaatggcaatgagcggaaccgcaatggatccaagaaccgccagcgccttgataccgaaataggcggtaagcgtcatcacgatgcctgtaatgataatcagaatcgcaaccggcacatgagtcagctccgataccgggatcgcaaacatggcgacacccacgccaaaccatccgatctgtgtgaagctgattaaggctgatgggagaaaggaaccgacctcaccgaaagatcggtgcgccagtaaatccagcgtcagccccgtcttctgcccgatataccccaatataccacagtaaatccctaaaaagatgttgccgatcagcattgccgccacaaatccggctgcgttcatgccgattcctaaatttcctcccgcagtcatgctgggcgtgaaaaatgtgaaccccaccagcactaccattgcagcccacagcccctgacgcttcagctgagacggtacggcggtaagtgaaaattcggtatcctttgccgttgccttttcctttgtcattgcgcacctcgtcttcttatttataatattgtctccagagcgcatctgatcattcaatcggaatgcgttcttttccgtagactactatacaaatctttttatggaatgtcaatcaaatctatttttatccagtgaatatcgttcattgactttcgttcactctagtgctacaatgatttcagagaagagaggtgataccgtgaaggaagaaaaaataaggatttccaaaccgccggaggagcgaaaacaggaaattatggacgccgccatgcgggcatttacagaaaagggatatgaacaaacgactatgcgagatattgccgcagtgatcggcgtcgttcccggcctctgttaccggtattttaattcgaagcaggaattatttgacagcgccgtctcccagtacgttctggactactgcgcccccatcgttcaggctttaaagagataccgcggggacatcgacggattactggactgtgttgcggacttattcctggaccgcgacggcaaagagaaataccatgaatttttccatcaggctgataataaaaccttccacagcctgctgtttctgtccaactgtgattatttatttccttatgtaaagtcttttttcgacagcctgaatgaaaatggaaccgcggcggtcgccgataccgcttccttttccaaatttgtactttatggcctgtttccgattctgaatgatgacgaactgtctccggaaaggaaaacagaattggccagaggctatattaccggactgctgaagctgtaatagcacagatattgacaggggaggcatttcgggcagcgagtgaacattgttcaatgagaggagtcttatcaatgagtaaaacagcattaatcaccggcgcaaccagcggtcttgggctcagctatgccagatactttgcttccaaaggatgcaatttaatcataaccggacggcgggaaaacatgatcagggaaaatgcggaaagcctgcaaaatcaattccatgtgaacgtggaggtcgtcatcgcagagctgtccagcttagacgggatcaatcggttcctctcccaaatcggagatcgaaccatcgacattttggtgaacaacgcgggcttcgggctaaaaccggcctttgtcgataccccggaaacggatgtggaaaagatgctttatctgcaggtctggtgtgtgacaaagctgacccagtttgtactaaagggcatggtacggaggaattccggtgccatcattaacatttcatcggacggcgcctttgccgttctcccgcacaatgttctttattcgtccacgaagctctatattataaattttactgaaggcttacatatggagctctccggtacggacataagggtacaggccgtctgccccggatttattgattcacattttcatgaaagcgctgaaatgcatatggataagagcaggaagggattattcggttttcgcgatcccgacgccatcgtcgccgacgccatgaaagatttcgctaagaaaaaggtcatctccgtacccgacaccggtgcaaagatgatacggactctcgccagattcttacccaggaacctgttttaccggatggcggccaggttttccagcagtctctccggcaagaaataaacggccacggtaaacggccacggtcagtcgcgtgttctgaaacagaatagagagtccggcaagccagactctctattctgctgcattttcaaacagctcaaaccggtctgttataatcgtttcatcatccaatatgcgtctgcataagtcccatccttatacttcatattgttcggaaatgtcccgaagatttcaaaacccatcttcttatagagagctatcgctctctgattatcagctacgacttccagctcgatctgttcaaattgatgctctttcgcaatttcaatcagcttcccgatcatcgcctttccaatgccgcggccggtatacttttgatacagcgcgatccccaggctgacgcgatggtgatatctgccctgttccatccccatcagggaacagtttccgacgtactctccatcgacaaatccaagaagcatgatattttgtttcgactcattctgattatgtatgaattttcgctcgtcatccagcgttaaatcgatctcttccggttctttcacaagaaacctggtctcgccgcacgttgtttttaagtattccagcagcatttcggcatcctcttctccggcatttctaagaagcagctgatgatcgcccagatcgatgattgcgtcctctattctcatattaatcctcccatattcctaagagactaccgtaaaaccttttcccgccagacacgcctcgaccgcccggatatcatctgcatgaaaaatcaggatcggcttgttggaatcacggttaaatgacaggtaaacgtaatccacattgatgttgctctccgagagagccatcaaaaggtgatgaaggtttcccacttcatccgccatctcaacgcccaccacgtcagtcagtttgcacagatagtccgccttctcaagtgccgttaccgccttgtccggagcagatacaaccatacggataattccatactctgcactgtcattggttacggaaccaagaatattgatgttctcctcctcaagaattccggtgacgtgcttaaatgtgccttttctattctctgcgtaaatcgataattgcttcagcataacttatcctcctgattgtttactttcgccttatggctcgctgattaacagattataccataaacctgtccattctgaaaccacctctgttatagaagctctcccagaatctctttcagaattttcatctcctcttcggacagcgtcgttccctttcccatcttttcgtgatccggcgcccagtcacggatgtcatacttcggggcaccgccgttccagctgatcagattcacttcttttctccagcctttggcattctcggacagaacgccaaactcttttacaatatcatacttaatatccgccattctctgctcctctttcccgtttctttatttcctccgcagtcggaagttccagatcctcttttatatcggcatctgcctccatgaccgctttatagtactgatggatcgttttattgacagaaataatccggcttttgggattaatccgttttactgcctcatcaaaatcctgtgtcccgcccttttccatggcgtctttgatctgcaggtaatacataatcaggtgttcccgcttctcgcccggaatcagttcttccaggagccttcccaccttgtttctgtgcttcgcaccgtaacggaaataatggtgcagggcttcctcttcccgttttctctgttcttccctgctttctatggtaaatcccataaatttcatattaatcacctctgtatgctgtccggtcgtcctgagtatcagccgcgtgctttcagaatatcagcctttttatgatctgtcaatcaccggatcagccgttcatcgcttatccggagctgtgaaccgcagaatatgggaacacggtatacccatagaataaagagtccggcgagccggagtcgcgcgccggagcgcggctgcttcagcggccatacttccttagcgcggagtgcgcctcctgccaggagggcttttttgtgtaacaggagcgctttcctgttacataaaaaaagaaaaggcccagtaaatactgagccttttgagtggagtagacgggatttgaacccgtgtccaaaaaccaattccctgttcttctactatcatagtcagttattttacattccctctgtcacccgaaaactgacaccctggtgagttcagtagcttcatcatacgcccatatgctcaaagctttgcataagtcgtttctcacatcgtcgatgccggattcttaaggtgtgagtgccctaaggccgacaagcagcattaagctgccagtgctaattcgttattgttagcgtttatatttaagtttgccatttaacgcatcgcatgcggatagcttcaccagctgcatgacccctgtcgaaaccagtactaccccggactggtgcctcttttgaggtatccttatactagcacgaaacgggaacgctgtcaagagtgctgcccaagattccggattttggaactgctaattttaaaagcctttttttaccagctctgaaacgatctggacgtagcattccaccacatcgaagcccttataatcttcccgtttcaagtcgatcatatccccgtgggatatcccgcggtggctgctgctggcaaacacggtacggaactctccccagcgggcggactccgtgctcaccaggccatcattgtccccttccagaggctttatgaggcagtagggaatccacagcagcggatcgctgaaacagtcgcgcatcttcgaagcatagctctgatagtaaacaccggacgcatcgggaaccgtttcattaaatgccctgctggactctgtggaaaactgatgagtggcggtatagaaatccgggttcttatccccaaatcgggaaaatgtccggtcaaagcatttggcaaccagacggtataagccttccggtaaacggactgcatagtcgacgaaccggcatccgtgatgcggggtgctgaccgtggtaagcgatgccgtgtatggcgccatccccagcttgctgatggcgtagcgcgcatccagaccgcccttggagtgtgcaataatgttgaccttttcacagcccgtctccttcaccacctccaggatcttttttcgaatgtcctctgcgttataggtgatggtccccagcgcctcctgattgccataatagacagtggcccctaaccgagacagttcccggggaattcttccccagtagttaaagtaacgcaggtcgcggaagccgactccgtgcaccatgatgagcggatacttcgtccggcagagatcggactccacgcgggtcgaccggacggactccttgtagcaggcaaaatcatactccgcccgcaccagtctcatggcatggagcagcacagccagattgacaatcggaatccacatggccagcagcatcaggacccgcattctcacgcggagacgcgccgacgtaagatacatcctcagaattccgttccacagaagaaccagaagagccgctgccgcaaataccatattgccgatcaggactcccgccggccattccgccgcctctgcgctgccgcggagcaggcggggatataggacaaatgcaatcaggcactgtgccagaattccgtaaatcgccgcaaatccaagagtccgtcccccgcgcataataacgagacgcagcttagcatgattcttgtcatggtacggtcttatattaaaatagagccagcaaatgcttaagagaatggccccaacaactgccgctgcgggctgcggccgaatcgtcccttccatgaggcgtccggtaaataagccgtacacaagcagcggaagattcgataccgccgcaatcataagcgccagatacagcttccttaataatctttttgccttcatgagtttactcccctctgtcttcttctgttatccgcctatgatgccccctgacacctgctctttaacgttctgctccgtatccgcgtccctgttgaatatccagatcccaaaacagcgaggcgacggcagcttcatactccgcggcccgctccgccttgcgaatcttctttccgtatttttccgatcctggaaacagaaacagcaggtaaaaccagagttccttcatcttaaacaggacgttccggtcgccggatatggtttcccggtagccctggtaaatcatatcgtgaaattccttaatccgggctttgtccgggaatccgaatcccttgatctcaccggccagtccgggatttgcgatcaggccccggcccagcatgatgcagtccacctccggaaatccggcgtggaactcctcccagtccccgggagtgaagatgtctccattgtaccatacctcatttctgctggctttcagagccttttgaaatgcggcgcggtcgggcgtattcttatagaaatcacttcgcacccgtggatggattatcaattcttttaagggatatttattgtaaatctcaagcagttcctcaaattcatccggcgatgccattcccagccttgttttcacggaaaggcggatatggattcccgcacacacctcgtcgagaaacgcttccagcgcttcctttttcgccagaaaaccggctcccttatatttcgtaaccaccgttccggacggacatcccagattcaaattcacctcgtcataccccagcgcctcaagctcgcccgccatccagataaagtcctccgcacggtttgtgagaatctgaggaatcagggtaattcctttgttatgttccggaagcacatcatttcgctctctcgaagcgaagcggtggttctggttcggctgtaaaaatggagtaaaataccggtccacatggggaaacagcgcatggtgggcgctccggtatacatagcctgtaatcccctccatcggggcaaaacagcagtatggctccttatgatcttctctcttttcaatcaccagactcgtctccgcctttcaatccttttattctcgcaaaatagctgacgaccagcaccacatccgcgccgatccaggccaggatctctgcataaaaaatgccctcctgccccatagccagcggaagaaacagcgcagctcccgttctcattaaaaattccaccacgccggacagcatgggcagaaccgtatctcccatcccctggatggaggaacgaaccacgtgaagcaggtaaaggatagggagacagacgctcatgatcgccagataatggtaggcgatttccatagtcctggccgcctcttccggtgttcccgtgatgaagcacccgagaatcgcctgcccgaagaccagcatcacggccgcgatcacagccgaggtgagcatggctaagagaagccctgatttcatcccctgcctgatgcgcctgatctttccggcgcccagattctggcccacataagtagtcatggcatagccataggaggtcgcggcgatctccagcagtccatacagcttgttggtcgccgtaaatcctgcgatgaagagaactccgaatccattgaccaccgactgcacaatcataccgcccacagcgatgattccattctggaatgccatgggaattcccagggtcatcagctttctgcaaagatacggttccaggtgaaaatccttcttttcaaatgaaagaatcgacacctttaacaggctccttaaacagtataaactggagcaggcctgcgcgatcagcgtggccgcggccgcaccgccgatcccccagtgaaagacgagtacaaacagcaggtccaggccgatgttgactgcggaggccaccaccatagcgtggagcggtgttttcccgtctcccatggcccgaaggatggaggccagaacattatatgccatcacaatgggaattccccagaacatgatccttaaatacaaaagactccgcccgatgatttcatccggcgtattcaaaagcagcaggaccggccgcgcggccgcctgcatgagagctaacatgaccacagatccaagacaggccagaatcgccgaatttgcaattacctgccgaagctttctgtaatcaccagccccgaattcgtaggccatcagtatggcaaatccctgggatatgccctgaatcatccccaacaccatccagttcagccagtccgcggccccgagcgcagccaacgcgccgacgcccagcgcctgaccaaccaccatggtgtccaccacggtataaaactgctgaaatacattgccaaacatcagaggcagtgaaaacgcgaaaataagcttcagcggatgcccctccgtcattgtcctaattttggccattttaattttctcctgatttctttttccttttatcaataccgtatatttccagaatgattataacctgtcaaggcaaaaagtgcaatccgattccggaaagtgtccggcgaagggcgaagcggacgcaaaaataccgccgctcatgacggctgcatgggcggcggtattttacggaatgcagtggatttcaaacaccattatgggtgaaactgtaccggggtcacctccggtgtcaggggttccatccggtattccgggaactgatcgatcagatcgttcaaacagagtgccgtgctgtgaacaatgtcgtgggccagcatcaccacgtgttttcttcccagcgccgtctcccgggcgttcgcaatcagttcttccggctcggatttctttaatgcatcctccaggctggcattccagtcgaaataaatgaagcctctggccgtcatctctttgataatatcctgatataccggtttattgtatgcattaatgcttccgcccggaaaacgaaagagcgttactctcactccggtcacttcaagcacagttttgtaggcctcattgaaatcttcaagatagctggctgtgctttgataaatctgctcgtaatcatggcggttgcagtggattccaatggtatggccttctgctgcgatccgctttgccacctccggatttttcctgacgttttcgcctaccaggaaaaatgtcgcctttatgttccgggctttcagcacatccagaacggcggcggtattttccgcagaaggcccatcatcaaaggttaaatacatggttttggggtggaagaaggcgtcgatccctcccgcgatgccctccgccagcttctcctgatattccgcctgggtaagctttccgcgttcctccgggctggacaggaagccggtctcgatcaggcacgcaggcatcttcgtccagcctgtcaccacaaaacccgcgtcgccccgcagttccctctccttggctccagtacgcttcaccgtttcctcatgaatcaggagagccagccgcctgctgtcacgggaggggtccgttccgtcgtaccacgtctcgattccggttggctcttcctcttcatacgtattctgatgaatgctcacaaaggcatcggcgccatagcggttcgccgcttccgcccgctgctccttcgtcatataggtatcagtttcccgggtcagaatcaccctgtagcccgattccaccagctcctcccgaagcttctttgcgatttccagattgatgtccttttccagtaccccgtctgcgtaacagccctcatcggtccctccgtggcccggatctactataataagcggatgttccgggtcgctttctgtggtctggaaaactgtttgtttctccgtccggctctgtacgccagtttcctgccatgtgccgcttctatcattcttgccagctgcctccaactggtactctgccaattttctgatttccgacgccggcagagcctgtaatgctgccggattcgtggctgccgcctggccctcagttactgccggattcaccgctgccgcctggttcccggccgctgcctgcgcctcagccgccgccgtctggctcccggccgccgcctgcgcctcagccgccaccgggctcaccgccgcatcacctcccggaaacatccccatcgtctccattgccgtaaacagaaacacagccgcaattccgccagccgctgccgcagcacaatcctccagccatcttcttctcgtgtttctcccgttttttctgcaacgggtttctcgttcgtatctcattgtacagctcctccctcgccagggcatgtttgaaaattcatttctgccgtctgcacgccctgcgaaaccgatccggaaggcttttgtgcagtcaaacacctgccgcaggcagcggcacattaaaatgtccctttctgctgcacaaaagctcctgtgtcatccgtctcaatattcattgattccagattacacaggagctgcatcaaaagatcatcatttttgcatcatagttgcatcatctcgatatttttacaaataattcctggataccgtcgtaataaccgaccgtcgcagtcgtatttccttttccggttccgggaaacacgtatttcttaaaatacggcgtcatttccatcagcggattgtttccctcatagggctgcggagcttccagtcccaaatatccgctccacttcccggcgatctcatccggatccatgtcagcccaggtgcgttccgtccggacataaaactcatatagttttccatcgtccgcgtcgatataggcatcgatcaggcggtttccccggtcgttgtttttctgaatgttggaaaggctgaccttccacactgccacgttattccgaggctccagcacgtcgatcgcagaatagaggacagcgtcgtaggcggaacgatcggcttctctcacggaatcaggaagaattcccagttctttcagcgtttcaaggccctcgtttacgaccccaaacagctcctcctctttgatctcacgatcggacggacctctgtgattgacgataaacgcatacgttcccgccgtctctccgtaggcttcaccggaagcctcctgcctctccccggcatacggttcgctctcgggaagcgtctggctgtttaaagcctccgccaggataaacagcttatcactgcggcttaaggagtatcggtacccctcgccttctccctccccatcttttacgtggatctcattcaaaaccgatttgtcgcggtatccggatatggcttccggcccccagatggccagagccatgaccagtgcggcaaacagaagcagcaagaaatttaaagctgtttttttcatacttcgccacctccttcaccgtcgctccgccaggcggcaggagcgccgtcttcccacgggaggacaaagctgaagcaggagccttttcccggctcgctctcgatttccagcctgctgtgatgcagaagcagtatctcctcacagagagccagccccagtccggctccgtttctgctcctggaacgggatttatccaccatgtaaaatgccttcgttatcttgtaaacttcctcctccggaatcccgacaccgtgatccttaacggaaaagcggtagccctccgaaacggcatacccatccacatcgatgcggctgcctggctctgatgccttgcaggcgttgtccagaagattgatgagcacggattttatcaggcttgcgtcacaccggatcatcccttcatcgtaagtaaaatgaaaatccatatttttcttcgccgcgtacatatcatacaggtagaaaaacagcgattccgcagagaccatctgaagctcgatctcctggcgtttcgtcacaatgatgtctaacagccgaagcgacatcgtctccagacgccgtccttccgtgtaaatgtaattggcgcacataaaactcttctcctcatccagccggtgagaccgcagcatatccgcataaccaatgatcgcggtgagcggcgtcttaagctcatgggcaaaggcacccacgaaatcttccctcgcccggatctcttcttccagcttgatgatattatcttccagcgcgttggccatacggttgaagtccgccgtcagctgccccagctcgtcgtcgcttacgagcctggcgcgatagtcgtagtcgcccgctgccatccgttttgtggcccgcgtcagcagccggatcggccttgtcagccaggaggaaatgaaatgcatgagaaccgttcccagaagcagaataacaactgtcaccctccggtaaaccacaaagcccgtagcccggtcatgaaacacctcggtgacgtctctcatcgtctctaaataaagcctcttatccagcgcctccacccgggcggccgtctgaatataatagctgtcgtccagccggatcacccggtaggtcttcgtattttcgtcaagtgcgagaagcagcccgtcatcggccgtgaagccgtcggctgcgtaaagcacctgtttctgatcatcggaaatccgcagcatacgtcccgtgtcctgcccgcctgcctctaagttggaggcgatctgacgcgttgtgtcttcctgcagcacatcatatttggccgggacattgagcgcggccgtctcaaatgcaaacttcagaatgctgctctcatcaagcgcctgcccggcttcccggtccagggcacgttcaaacacgtaattgacgaaataaaacccgctgaatccaaatgcagccgccatgacaatcatggtccataaaagcagtttcagtgaaaatttcatcgccctacctcaagccggtaccccaccttatatacggccaccagccgtggaaattcgccgttttcccagttcagcttcttccgcagacgctgtacatgcaaatccagcgtacggctgtcgccggagtattcgccctcccacaccttctcatacagcgtttcccgaaacagcgccacattccggttccgcaaaaagaggaccaggagcaaaaattccttattggtcagctccaccggcattccgcccttcatgacggtcctcgcctccacatcgaccaccacgtcgcccgcagacagacgcctctccgtcttattgtatctgcgcagaaccgcttccactctggccaccagctcgaccacatcaaagggcttcaccagataatcatcggcccccagcttaagccccttcacccggtctctcacctcatattttgcggtaatgaaaataacgggtatctccatggggcgtatgtattccatgatgtcgaagccgtcaatccccggcagcatgatatccagtaaaatgaggtcaaatttctcattttctataattctgagcgcctccgccccatcctgaaccgccgtgcagtggtatccggcctccgacaggttcaaatcgatcagatcgcaaatcggtttctcgtcgtccactatcagtatttttatcatgattcctgtctccacccccaataagccctggccttttccaccagttcctccatcgtgctgtcgtctttactctggtactgtttcttaaattctgtttccggatagaatccgcccgtcttctggtaatagatggaataatcattttccaggatcgtctcaccgtcttttccctcatagctgtaccgcgccagaaccgccagatccttcatcccgtcaccgtcaatgtctcggcaggcgactcccttcagcgcatacagattttcatagtcgcccataggctggaagctccatacgatgtagccctgctcattgacgagatagaccataaatacggtatattccgccatccggtacgttcccggaaccaccagaaggttccccagcttctcgaacttgcgccagtaactctgctcggataccaccttaaatccatgttcctttaattcatccagcgtagcggctgtatacaggaattccgttgaatatccatcctctaagaaagaggcgataaaccggatacttttgttcattccaaaccggttaatcttgtcggagaggcgccagtcgcggtaaaaaccagtttcattctgaaacagcacatctccaaccttatatgccctgcctgcggcggaatcttccttttcacaggaagtaatcagcagaatatctgtctttccgtctccgtctaaatcctgaaaagagacggcggaaatcccctgattaagctgattaagctcccctcttacctgattgtttgtctccagctgatccgtctgatagaccgtgtttccgttctcatctgcaaaaaacaggacgaggcggtgatacgtccggtcaatggcaggaatcatggagacatccccaaatgcttttaccgtcatggtaaatacctggttctcaataatatcgaaaccgcttgcggcgatatccgcctctttcttcacaccttcaaggcgtttctgataggcattgtaggcgtaaagcgcactttgctcctcctccgcctgcacgggaaagcggccgggacaggccgcgaaaaacagggacaagcacagaaggcctgccgcggtgcggacaaataattttctgtatttcaaagggatcacctgcctttttcttcggactcagacgtcattcgtgtacattgatattttatcagacatagcgggaaaatggaatggcgaaagcaaaaaagcaagagccgcccaccggacatttttgatgattgggtggttcactctcacctggcttcacctaactcacaaaagccttcctgaactcttcgtatgatatttttcccgaagtaaaccctttaagtgccagatatctcttttccgccgttgtattatcccggttgtgacaccggtccacgagcctgtcttcctcagccagcggctgttcgatatgcttccgctcactataagcctcaaagtaccgcaagccaaactttctctgtgaaacggcattgatatggattccgtccggatttgccgtaagcccttttgccgtgacaaagtaacagcacggattctcctcagcaaaccgctgcagctcctgattgatccgttcatactcgatgcatcctgcaccgaatgcggtttttcccagataatccccaagtcctcctatgataaacggaatgtcggcagcattcagtgcctctcttaaatccgtcacaagcctgtacagtttttcgtaatacgtcttatattttccgctgtcactgtcgctttctccctgatgccacaggattcccgccagttcactgttctccaccgcaaattttgcttcgctgaccgcgtggcggaacagcacgccctccgtctcccattcatcgatggagcttccgccttccgcacacggaatcaggcctatcttttcatccggattcatgcggcaccaggcttctgcaaaggatgccgccaggcttacgcctgcaaccggccggtcatagtttatcggctcagtcatcatctgccatcttccgttgcgcagcatcccgattctttcattatagattgagggcacttcatgaacgaagccgcgccctgccatgtttgactgtccgattaacagaaatgatttcatggattcctacctccgttacaacaaattattttttcctatcagcatccttcgcattgtgagcgaaaaaaatcagggcggtaaccggtcctgttgtatccagtataccatgaccggaataaaatttcagcagtttttggctttaccgtagttcacaacgctgtctttctgttttataatgaacctgtaagtacacatacggaggatgtctatgaacgaacgaatcgtggaatacattaacattttaggaggattttgcggaaaaagagacgtttcccaactgtctcccgaagaattaaagaaaacttacggaatcgatcaggcagacgttatggtgctgtttggcggcagcattctgtgcggcggcgatgtactggcccaggcgatgcagaaccatgccgcgaaaaagtacgtcattgcaggcggagccggccataccacggaagcgctgcgaatccaggtccatcaggaattccctgatattgagacggcagaactgccggaagccagggtctttgcttcctatctgaaggcacgctatgggctggaggccgatcttctggaatgctgctccaccaactgcggcaacaatattacgtatcttctggatctgctgcgggaaaatcagatttccttccgctccatcatcctggcacaggatgccaccatgcagcaccgcatggaagccggactgcgcaagtacgtctcggatgacgtcaccatcataaattatgccgtctaccaggcaaacgtcatcatgaaggacgggaagcctgcctatgatacagaaatcttcggcatgtgggacatcgaccgttatctcacgcttctcatgggggaaatcccgcgtctcaccgatggtccggagggatacggacccctgggcaaaaattatattgcgcacgtcgacattcccgacagcgtcgccgccgcttttgatgagcttcagcacacctgccgcggcatggtgcggcaggccaatccgctgtatgcctcccgggactagcggccgttcaccactgccctgtttcaggctttgccagtccccgcacccgggtctccgttacgggcctcataatgaaaagcaggataggattaccggcttgtgatgattctgccggtcattctatcctgcttttttctatctggattaatcccaaaatgaagtgctttcctgaaaaatgtcaagtgctataaagatatactcctgcagtaattccaactccagtccggtgtcagatttctggctggtacggtgaattctttatccgcgtccaatcctctctgcgatctccacaagacttggcagacaggcatcaaagaacatcttatacgactgacagaagtactgatgattcccgtgatcctcctgtctggttctccggcagccgccgcggcagagcattgcgtatcggcagtctgcacacgcctcctccttctgaagggatttctcgataaattttatctcttcccgcttcttatctatcatctccaccgtatccgtccggaaattccccagacggtactcgtccagcacatagaaatcgcatggatacacggttccatctgcctctaccacgtactgcattccgcaggtcccgcgcatgtcgcaggattccggcatctggcccagcagaatcgcgatataattctcaaactgccggatatacggctgttttccctccttcagatcacggaaccacagctcgaacaaatcgatcagaaacgttccgtacgcctccggtgtcagcgaataatcccggccccccggttcttccatgagcggatcgagacaggcgataaactgcaggtaatttaactggtttttccggtagaactcatacgtttttttgatatgaggcgcggttctcgcatgcaccacggaaagtatgttgaagtccactccggtcttcttaagcatttcaatattttccatgatccgggtaaaactgccttttcctgcgggagttttccggtaataatcatgctgcttcggtcctccatccagggatacgcccacaaggaaatgatttctcacaaagaattccgcccactgcttatccaaaagcgaaccattcgtctggattgcattgaaaatcttcacgttattgacattgtatttttcctgaaattcgatggacttttcaaaaaacggaagcccgctcagcgtcggctcgcctccctgatacgcgatcgtgcagcttccctccgaataagccagaacctggcggatcacatcctctaatgtctcaaccgacataaacccgtaggccccctgttcccgtttggacatcgtatcataataaaaacagtattcacaccgcaggttgcaatttcctgacgatggtttaatcagtacactgattggcggcataagcaccctccctctttcgtaccggcaatcatgccggcggccgttttcataaacacactgataaatattataatggtttcttaccgtaagtacaagagtaaacttaagccatgcccggtaattaagggaggtgttccagtctctcaatctcctccacaatctcttccagcgtctcaatctttaccgccccaaacatcgccaggctccgcagaggcatgtcaaaaagcatggacagcatcatgcggctgatgtcgtcttcgcctgcgtactgggccgagtatccctcgacaagaccgcccagcaggacttttcctttttcgctggccaaagcttcttttacagttgtattcagtgtaattctgctggcggccggcgttaaggggagttcccccttaaacaggcgcttaaactgctctctgtctgctgagaaacggccgtcctttacgacttcgctgacatcatatccgggtatgccggaaagctgtttcccctgaagtttcagctccctgctgagtcttaactcacggctggaggacgccgcatagatctgatacgtgcccgcttcaactgcccagccggagaggtccgtatcgtaaatggaaaaacttctcttgtccaggccgattaccacttcctgcgattctcccggctgcaggaacacttttttaaagcccttcagttctctgacagctcgcatcacagccgactgttttttgccgatatagagctgaaccacttcaccaccggcggttttacccgtattggtcactgtaattctggcctcgcccatctctgcctcttcatcccatataaggtccatggtatcgtaagagaaggtcgtgtacgacagtccgtatccaaatggataggctaccggtttttcagcccagtcgtagtaacggtagccgacaaaaatactttcgcggtattccacgtcctttccttctcctgcgaaatgctcataacacggggtatcttccagtgaaagcggaaacgtctccgccaggcggccggaaggattcaccgctccggtcagcacatctgcgcaggcgcttcccgccgcctctccgcccagacaggcgagtaaaatactctccacccgctctctccatggcattaggacgacggagccgcagaggagaacgaccgttatatggggatttaccgcagctaccgcctcgatcagcgccgtatgggactccggcatattcaaatgcgtccggtcaaagccctcactctcataggagtccggcagtccggcaaatacgatgacaccatcccgccccttggcacaggcggctgcctcttccatcagcgcctgattgatggtatcatgttccagctcataaccaggtgcatattcaaatgcaatgccattttcgcggagagaatccagcacacaatcgacctgatggggattgatctttgagcttccggcgccctgatatctgggcgcttcggcaaatgcgccgatcaccgcataggaaccgtctttcttgagtggaagcattccgtcatttttgagcagtactgcggattctgccgcaatccgccttgcaagcttatggtgtgccgccgcgtcgtactcttttttgcggacctcacaggctttcctgatcatggtaaggagacgctctgccgcgcggtctaataccgcttcatccagctctccatttctcactgcatcggcaattttcttatcattatggggatccggtcctggcatttcaagctcaaggccggctttcagtgctttcaccctgtcattcatggcgccccagtcagtcatgaccagcccctcaaagccccactctttccgaagaacctccgtcagcagccactcattttcacaggagtacacatcgttaatccggttataggaacacatcacggtccacggctgcgcctgttttaccgccttttcaaacggggccagatagatttctctgagcgctcgctcgtccaccaccgaattgctgacaagcctggccttttcctgattgttggctgcaaaatgcttgagagacgttccgattccctggctctgaacaccgttaatccaggcagctgccatctcaccggccagatacgggtcttcgctgaaatactcaaaattacggccgcagagcggagaacgcttgatgttggttcccggtcctaaaataaccgcaacctcctcctgaacacactcctccccgatggcctgccccatttcatacagagcagcttcatcccagctgctggccgaggtaaccgcaggcggaaaacaggtggccttcacgctctggtttagccccaggtgatccgcctcgccggcctgcttgcgcagaccgtgagggccgtcggttaccatgatggagggaatatccagacgttcaataccttccagctgccagaaattctttccagagcacagaagcgccttttcttccagagtcatggtttttaccagagcttttatatgatctttgattccatttgtcatagttttcaacccttctttctctcgtccagttccgtgcggatctgggagtatttctcattggtaatctcatagaatgccatggaaatcagggatgctatataaccgagtaccggcattccgaaacgcaggaacacgatcatatttaatacctgcggagtctgctcctgatttgccacaaagccgaccagtcccaggaagaagctggcaataaatccgccgatcgccatgccaaacttgttgataaatgtcagggaggaggacatcaggccatctgctctctgaccgaatttccactcgccgtaatcagagcactccggaagcatcgcccatccaaggttgcttggaatacgggaaatgaatccgaatacagccatcatgctcataagaatcgtaaccgatgccgtaggcttcagccacatgaccaccagcggtacaatcgagaacaggcttccgaaccagtacaggcgttttttcccaaacactttggagagtgcgggaagcagcggaaggagaatgatcccggcaaacagaatggcggaggcaaccttgggaaccagatctacccggtttaacacatacttaaagtaatacatatttacggcgctgtaggtcgcgttggccagtacgtccgtaccgaaggcgatcatgagcatcagcatgggtttgtttttcaccagcagcttcaaatcttttgccatgttcatcggaacgcgttctttttccatatcacagacatcgtacttctttccgccccatgcgcagatccagaatgcggcagtcgtcagaatgccgatgagagcgccatagatggcccatccctgttttccgccgccaaatgcttctaccagcggaagtgccatgatggtgataataaactgggatacggttcccatgccctgcttccatgaaacgataaccgttctctgatacggatcctgagacataaccggcgtcagggaatgatacggaatatttactacggttgaggccagagaataggcgatgtagaccacatagacgtagaccactttcatattcggtgataagtccggtgcggtgaaaagaaggaagataaggaatccaaggaccggagctccccagataatccatggcctgtattttcccattttcgagcgggtgtggtcacccatcattcccataatcggatcggtaaatgcatcgataaatctggatatcagcatgaggcctgaaaccaccatggagctgattccgaagatatcggtataaaagaatgtaagataagacattacaagaaagaatgcgaggtttgaccccagtcccccaaatgaatatttgaacacatccaaaaactttgcttttgcatacttcgtttccatacgtttcttctcctttataaataaatgtttcgtgtaaaatccttttccattctggtgtctttttgaaatggaacgacgtcacacgtatcctggtaaaattccaaaagcttttccttcatttccgcgattatgggcgcatattcagggcatccgatgcggtttttggtctccttcgggtccagtctcaaatcgtagaattcgtcttcctcatagagtcttctgatatatttgtaatcccctgtacggcacatcgtggcttttccgttgtacatctcatcggaggcctgtaaaaactgcctcggatagtactggccgcccggatccggtacggcctggccgccggtctccttgcagtggtcttctccctttcggaaaccgccctcacagaacaccgcctggcgaagcgcctcttcccgctgttccatataaggaatcagggattttccaaaatgtgtgtgttcggcgggcagctcagccaccgcctccgcagttgcgtagaaatcaaccagctccgtcatttcctgactgacgccatggcgtttctgcatcgcggcgggcagcttcacaagaaacgggacattggtcaggcagtcctcaaaacagttctgaaccttctccaccagaccgtaatctccggtataatctccgtgatcgctgaaaaagaagacggcagtatcatcgtagatgcctttttccttcaatgcacggacgatctgacccgtcaaatcatccaccctgctgcacatccctaagtaaaccgcccgcagctcatcgtactcctcttcgctccagtccttcatgttctgcagtaccgccagttctctctgcattctggattttcccctatatccctccggaggcagaatccgttccggcagcttcttccggtcaatacggctgaaatacggctcgctgatctgataggtcgggtggggaagcatcaggggcagaaagatgcagaatggccgttcctcctcatagtcccggataaattccgccgcgccctccgtccagacctgatccaggtctttatgctccggcagcctgccccggtaaaaggaatagaaattctttcctcccggttcaccccggaatgactccctgggcagtgcatccggcttccgatcatttccgacagtaaaataagtatcacaatagcttttataatactctggattctgtgccggcagcaagtcatttcgctggttcatccagacatggtacccgtgctccttcagacgctttaagagaaccggctcgtgctcatgcatcatgtgattcatggtacggtgtcctgcgacatggggataccagccgctcataaagctgcaccgcgagggggtgcacaccggattctggcagaatgcatgtgcgaaggataccccctcttttgccaattcatccagatttggcgtaaccgccgccggatttcccagatggaacatggaatccgcccgcatctgatccggattgataatcactatgttcgggcgttttttcataccggcctctcttcctcaaaacccagacggcaaaagagctctttcggagcgtcatttttctccatatattcccggatataagccttcatctgtgcgcgcacggcctcgtcctccagggaatgttcctgatccgggtcctcttttaagtcgaacagcagagaaccgaatgacgtcgtgtctcccatatggtccttactctcgatcttcataaccctgcagcccttcgtgaaggaaaatggctccgccagttccatccccgccagttcctccgggcggaacatataccgcatatgggtaggcatcagcgtgtactcacaggcaggaatctcgggatgctccgccgcatgcatgtacacataccggccgtctgtcacatccacctgacttccatggtatccgaacaccgcgtatttccggataggttcatccgaatccattacgccggcaagcggctttccttccatgtcctccggtatttccattccaaaaaattctaacagcgtcggcgccagatcgatggtctgtacgatcgcatttctgcggattccggcgcactcctttctgcggggatcgtaaatatacagcggtgtatgggaaatctcttcgtagatcggcatgctggtctttccccaccatccgtgctctcccagcagaaagccgtgatccgtattgacgataagcatggtatcgtcccacaggcggtattggtccatcatatccagaacctttcccaggtaccggtcgcacttggaaagcagcgccgcgtattcgtaacgaacgtgctgaaccgtattctcatcttccgccactgccgcgtaaggcggccagtcggcttcctctgccgcatctcccagaaaggtatggggatagagcgctttgtcctccttcagtgaatagaacggttcatggggatcgaaggtctcgatctgcaggaaccagttgtcctccccgtggttcttctcgatgaattccagcccctggtgaaatgtaaccgcctgggaggtcttctcttctgtatccatatagctgcggttgaccgcgtcctgagccatcattcgtctgtaaggcggataactcagcatgacctccttgttcttaaatacggtgccgcggtcatagcggtatgacaaatcggctttccacagatcaccctcctgccccctggaaatctcccaggatgaataccggttatggtaggtacagcccccatcctcccagtagtgctgatggtcgctgacgagatgggtgtagacacctccatttttcagaatctccggcatcgagtcgtcgaacggctccatcggcccccagcttctgtggaaaaagttgattctgcccgtgtgcagctcccttctcgccggcatacatggcatgcttcccacataacaattttcaaattgaacgcttaaatccgccagccttttgaaattcggcgtcttcgtccagtcacaaccgtatgattccagtaaatcgcgtctcagggaatcatacatcaccataattgccttcatgatactcctcctgtcttatcttatttttctgtatctgctgtactcttttatccgctctctttctgatgaaggttttcaattcgccttgcgaattggtgcaagcacccgtcataccgcataaccgaatacctttgtggcgtgctgtacatccatcattgttttgaaaacgctttcagaaaacgctttcaaaaaagagcgatcaaaaggctgctctttaaagctgccttattgattctctgtcaaaaaactttgtttcatattccctggaggtctcctccagcgggcggtcttctatcatgtccagcagaagctctgccgctccgctgcccatatccttcgcgggtacaaagaacgctgaaatctggggaaacaaccgccgcccttcgccactcttatgttcaacggacaggatcgacacggtctccggcacagaaagccgcagctctccgcacacactcaatataatctgggtcgtctcaatgcccggcgaacagatagcggtacagccgccgcctattacatactttctgaaatctgcaataaggtccggccggatatccgtcatatgtgagagcgcgatcggaatcagttccagttcttccagctcttcttttgccttttttacaatgccggccagataattctcatgagtcgtgtaaaaatagaggacgatcttccggtgcccgtctgcatacagcgtttcaatcatctgatgcatatagctttcgtactgagcgtaaacattaattcccttcttgtgaaactttttccctatgtataccacgggatactcttcatccaggatttgtttcagcgcctcttcatccatggatttgccgtttagcccgcttaagagaagaccgtcaatccttctctgcctgacatactccatgaaacgcggactccccttcacccggtttgagtattcctccgactcactgatcaataccatactgtaattatgtcttgtcagaaccctctcgattccctttaacaattccagagtgtaggaggattcgaacaccgatccggagtgaaatggagtatagactcctatcatattggacctctgcttcaccagtcctcttccgaactgattcggttcatactggtaatattccatcgcctcttttacggcctgtaccttcttatcacttacgttggcgctgttattcaaaatcctggaaacggttgagatagaaactcccgcccgctttgctacgtcgtaaatcgatgctgtcatgttttacctcaatgctgtcatgttttgcattcatttttgaaagcgttttcaaagttcctggacttataataacaaaaagagaaattgtacacaatatgatttttctacaaaaaagtattttttatttgtgcaaattctacaaattgcttgactcacttttttcgactatcgccccttgtttttctcttccatgcatgcagaaaggagccggcaaatgggtctccggctccttctgttcgtgctgttattatctcactgtttcataattctgttattatttcactgtttcgtgcttctttaccaaacgtactacgttccagctgtgtttgccgaaaacagtggagaaaataccgttctccagtttagaagcctctgaatggatcgggctcaccgtatccggcgctgcttctgtgttgactgctttcatgtcgtcatgggtcagaacgatatgttcctccacctgatacccctcaaactgacggaaatcacaggagacttctgcatcgtcctccagatctttattaaccgcgaaaatcgttacggcctccgcctcctcatcccagatgcatacacagtccagggtggatacggtgccataggtccggctctcatataccggggccttgatctgagtcatcagaacggtgcctttcccatagacgctggcgtgcatatatggatagaatatggtctgacgccaggcgcctgtatccgatgtcatgatcggtgcgattacattgaccagctgggccaggcaggcgaccttcactctgtccgcatgtctcagcatggtgatcagcatgcttcctaccagaagcgcgtcttcaaagttatagacatcctccagctggtgaggcgcctgatcccacgccttgatttccttgtcctgctcgttgctgtgataccacacgttccactcgtcaaaggataaattgatgttctttccgccgtgctttttagccttcaccgcgtcacagattgatacaactcccgagataaagtcatccattcccttagagcaggcaagaaaatctgccgtgtcgtcgctgcggtttccgtaatactgatgcagggataaataatccacttcgtcatagcattcgtctaaaacctggtactcccagtctccaaacgtaggcatggtcaggctggagctgccgcaggccactgtctcaatctccggatcgagccacttcatcatacgggccgtctctgaagcgattcttccgtactctcccgctgtcttatgacccatctgccattttccgtccatctcgttgcccaggcaccacagcttgatatcatgaggttttgcgtagccgtgagattttctcaaatcactgtaataggtgccgccctcaaaattacagtattccagcagatttttcgcgtcctccggacctctcgttcctaagttgactgccatcatcatctcactcccggccttcttggaccagtctgcgaattcattcagtccgaactgatttgtctcaatcactctccatgccagatcggttcttgcaggtcttagtgccttcggtcctacgctgtcttcccagtgaaagcccgatacgaaattgccgcccggatagcgcacaatcggcacctccagctcttttaccagttccagagtatcttttctgaagccctgttcgtcggaggaggcaagcccttcctggtagataccgccgtaaacggcacgtcccagatgttcaatgaaggaaccatatattctcttatcaacactgcctgtcaggaaatacttatcaatgataatttctgcttttttcattctgtcattctccttttttaactgtatattctttactcatatcttatcaggtccaggagaaaaaaccagtgacttttctccgaagcatttgattttttctccgattatgtttatactgttatcatcctataaagaatgaaacgaaacgaccagacggcagatgtaagggaatcagaaacaggaggaagggccatgctcaattttgaaatacatttctgtgaatacaaccggcagaatccgccaaaagacaggatttaccgaccgggaggcagcggtgaccacttattcctgctgctgaaaactccgatgaaattctacttgaataaagaactcacactggcccgggaaaatgcctgcatcctgtatacgcctcagaccatgcagcactatgaggctgttcaaaaattccggaacagttatatccatttttcgtgctccgatacgctcatcgaacgctttaaaattccgttaaactccattttttatcctggaaatcccgatgaaatcgatgagtacatcagagagcttcaggaagaacggatcgcatcccgcccatttgcggaggaaaaagaatattttctgctgaatgagatgtttattgccatagcccgggccatggccggagagaatactgacattgtggagaaccgggagctgtatgagatcttcttaagtctccgtctcgatatgctccgtaactatgaaaagccctggacgacagaagatctgtgccgcagggcaaacctggagaagagtcagttttttgcctgttaccagaaatttttccagagtacccctcatgcagaccttctctccgtccgcctggaaaaagccaagaatctgctcacaaatgaagcgcttccgattaatctggcggcccggcaatgcggattttccgatatcacccacttttcccggtattttaaaaaagaatgcgggtgttctcctaaggagtacgcccgcagatggaaagaaaattgtttgccatagaattcgtatatttaagagtgctgcggcgaaacggctcagacccggagcagctttctcaccagagaaagaaccgctccggcagtgctgccgagaaatagaatatcacgatgggaattcactgcctccatggctgcggctgcgccttttgccatccccttccacgcctcggcttcagccggtatctccggcaggaccactgccgccgccacgactgccgccatgcagagaagaaacggcacaaagcctcttcccgtatcgtatttcttcatgcgcacgccgcctcccgctcccgtttttgagggaatccagagacaccagatgagccccataaacagcgtgattcctgcaaagccgacgtagagagccattccgtagttggactccgccgccatgaaccggatatcccccagcgcctggccgtgttcccagaatgactgtgccataaggaacaccatacccgccatcaggagaaaggaggccagctgcatcactctggagatgattacagtggctgtcaccatgctttttaccaccacatcaccaaaactgacgccgtcgttgcttgtcttttcgattatacgggtttctgaatccggtatgtcgaaatcgcggcttaccctggagtctgcattaccgcgcatagatcggcttctctggttctttccccggggcagcccgctgtatgccgaactactgcgttccccgccgtcccagtcccagctctcttctctctgtgcttttcgccctgccattccgcgtgaaaccggccgtaccttttcccgactgtcattctcttgactgccgttctcctgactgctgcgcaggcgctctacctcgccctccagctttttcattcgagcttcctttttctgctgctcttttcgctcacctttcgattctgcttttcgtccctcagagccttctttggactttttaggctttggtgttttctctttgggcttctgtttttccgactttctgttcctcggctgatagctttcgttgtcgtctgcctctgtatcgtcaagagaattacgcctgccacggttgtttaagaggttggtatcatcagtctggttctcataggactgctgatcttctgcatttgaagaggcttctgtaaaatgacgactctttaggagggccagtgctccgatgattgatttcgccggattgaaagactgggattctgtgagtgactggtcgtctataaaaagctggtcgtccgcatatacttgatcatctgcgtaggattggtcgtttccatatgactgtccagccaaaaattccggatcatctgtatcataccggttatccaaatatgaaccattgcccatatacattctattgtccgcattcgttccatcgtccacatacgcctcgccatcactctccattcgttcttttataaatggcggttcctctgtgtttaaccattcttccgctaaaagcttttcctctgatcgctcgctcttaaccgtccaatccccccggctcttttgtccttccataaccggcggtgtgcttgcggcggcctgttcttccaggcccgccaactcctctgacagccgttttcttatctcatattcctcagccgattccattaaataaccggtgctcagcggttctccgcagttattgcagtagtttcctgatgtttcatgtccacatttcgggcagatcataccatcaatcctttcgtattattccatgtgtaatctgaatgcttctatcataataaagtcctgtcttaccgtaagtaataaaatcatatttcaccataagcggcgcaatattcgccgccgcggcagccgccaaaagaatgaacaggcatgtctgcccggcattgatattaagtatactatattcgctggcggggaagtattaagtttctcttgcaaattagagaattatatggacagaaatgcagaaaaacagcaagattttattgacacagcggcattcttatgagatactggattatatagttttgattactacatatggaggttccaatatgaagactgctattttgattgattccggctgtgacgtttctgacgagctggttcaaaaatatcatatgaaggttatgccccttcacattatttacccggagaaggattacgttgacggagttgatattttcccggaaacgatttatcagagatttccaaaggagatcccctctacctccacgccaagtccacaggacgttaaaaatatggtggaggaaatgaaagcggagggctatactcatgtgctggcattttccatttccagcggccttagcggtacgtataatacggtcagccacgtgctcggtgaagaacaggaactgacttcctttgttctggataccagaagtgtctccttcggcgcgggaattctggcgctctgggcggctatgaagctggaggaaggcatgagttatgatgagctgaccgaggcactgccgaagaaagtgaaggaatgcaagatattttattacatggatacactgacctatctgcgcaaaggcggccggatcgggcttgtcacctcagtcgtaggcagcatgctgaatttaaagccgattatctcctgtaatgaagaaggtgtctactatacagtcgccaaaatccggggttccagacagggactttccagacttctggcggaagtaaaggccttcgcgggcgacggcccctgcctcaccgccctcttaaacggtgacggaaaagaagcggctgaagaactgcggccgaaactgctcgccggtattccccagggaacgctgatcatggaaaaggccataactgcctctctggccgtgcataccggtcccggattggttgggattggcgcgcttaaattataaaacacacataagattgaatataagcagacgaataaaaattcccggtctcaagccaagaaccggggatttttttattctcctgcactcagcaattatctttatacataatcttccattttcattgacaatccccatctgcttctttatacttagagcaatgattgtcacgaagacaagttgtttcctccaagagaagacagtttcttatattgaaacaaaggaggtgaaaaattgaataaccgtaatgtaataaagaacttctttaaccgacttgcgccggactggatggatgaggatgaattagcccctgtccgtgatgagatcgtccgccgttctgcgctttccgaaaatcgcatcatccttgatgcagggtgcggaaagggtgtcatggttcctcatctcttaagcacgaatccaagccggcttctggagctggatttgtctgacgagatgatacggcttaaccgcctgcgctgggagtatgacagccgcatttcctttctctgtgatgatattctcactgccgacttaccggttcccgacgctgtatttatctttaatgcatatccccatcttttagacaaaacggctctggcaaaaaagctttctgatctgcttcccgcagatggaaccgtcgtgatcgcgcacagcagcggaaaagattttatcaatcagattcatcatgacagcggcgcctgcgagatgatttcaatccctctgaaatcacccctggaagagtatgagccatatggcaagtatttttcacttacagactgggaagacagtgatcggctgtattacatgaaattaacaagaaaataaaacatgaaattcatgtcacgaagacatcgtaaacttaatgaataagtttagatcttcgtgcttttttattttgaggaggtatttttatgaatcagacagtaaaacttactatttccggggcctgcgtggctctcggagtcgtgctgcccattgcatttcacagcattccgaatgccggaagcatttttctgcccatgcatattccggtactcttatgcggtctgctctgcggcccgttatacggtctgctctgcggcattctggctcctttgatttcaagctttgtcaccggcatgccgcccatggccatcctgccgggcatgacagcggagcttgcagtctatggactgatttccggcctgctgattcaaaagctgccggttaagaaaccgctggccagtatctatctctctttaattgccgctatggtgtcgggaagaattgtaagcggacttttgaacggattgatcttccgcgcaggccagtactcgcttcaggtctgggttaccggttctttcattaccgcgctgccggggatcgtcatccagctgattctcataccggtcatggtcgtcgcactgcagaaagccggattcttttctacgagacgagtgacagcataaaaaatgccatgacagcaggcgccggattaccggtatggcctgttgtcatggcattgtatttttctgttctagacccggaacctgtcatactctttccagcagtccaggcaaagcttctttccgtcctgaagccgcatcatgtgttccgcggtggtctctttgcagcagtcgcagggacaggaccggaacagcctggccctttccggaatatggcagacagcctctttcacgtcaaataagtcttccggttccctcttctgaagatacgcaaaagactcttccttcgacgcaaaatccggacgttctcttaacaccagacggacggacttccctgttttccggttataaaaggaaaacgcctgctttcccctcatatgaaacagcagattcccctttccaatgctgcatcccagcacaacctggatagcgtccacgccgcaggcgtcattctcggaaatacataccacttcctcgtcctcggaaaatcccagttccaaaagctccattgcgtataaggccgctttatatccgattgtcagtccgccgcacacgtgaccatgaaattttgcacactgttcccataattctttcttctcttctgctttcatttaaaattcctccatttgataaatactgcactcaatccggtccgcaacagggacaaacggctgcagtcttccattctttaacagataaatgcggtctgataccttcgccgcgcaggttaaatcgtgagtcaccatcagtatgctgaatcctctgctgttctgaagccccttcagaaaacgcagcacattggccttgctcgacggatccagcatggaagtgggctcgtccgcaatcatcagcgccggttccatggtcagcgcccttgcgatacagattctctgtttctgccctccggacagcttcttcactctggtattgaggaaatacgcctcagacggcagtcccacatcacgaagcgcctgttcgatccggtccttcaccgtatctgcgtcagcctggccggacagaaataaaggctcgcttaccgcttcccggacagtcatggagggattcacggattcattgctgtcctgaaataccatctggacaccatgactgctcttatgaagctgtttatagtcggcggttttaccgtcatacagcacatttccttcaaattcatccatatatccgcctagtattctggaaagcgtcgtcttcccaacgcctgattttcctacgagagagataaactctccgtgttctatctccagactggcgtcccgcagtacgtcctgcttcccataccgcttactgatgtgctgcgcctccagcagcgttacaatgccgccccggttgcaggctacctgccagccaccgccgttttccgtgagagaaggccttttcgtccggcagatatccagtctctgacagcatcttccgaaaaacggacagcctcccagcccctcttcctctgccggcctgatcccccagatatccttcaggagatttaaatccatggaggcccttaagagcccctgggtgtagggatgcttcggccgctccagaaccttttccgtcagtcccgcctcttccaccatgcctccgtacaggatcataatcctgctgctcagctctctggccaggcgcagatcatgggtgatgatcagaaatgcagtcccgtgtacccggttaatcctgcggatcagatcgataaacgcttttctggaattgacatccatggaactggtcggctcatctaaaatcaccatttccggtgtcagtgccatggcattggccagtaaaaacttctgcgccatccctccggatagctggtccgggtagcgctctaagtccgtttcctccagccccaccatttccatcagtgttttcatgcgctcccggtgctctctggccggatattttttaatcagcgtttcccggagctgctctctcagcctcatggagggattcagccattctcccgaattctgaaagacgatggaaaacagttccatccgaatccggcgcacttcctcctctttcttctcatacagggaactgccggctatgaccacctcacccgccacagccgcttcctcctccagcagacgggacaacgcccgggccagcgtcgtcttgccacttcccgactctccggctgccgccagaatctcccctctcttcatggaaaaagagcatgggcccagcgtaaatccgggatattccacagtcagaccttgtacattcagaatttcattcagaacttcactcatatttccctcattttatatttatgtttttgctgctctgttcctgttaatttctcatttcccgtctcattcctcccgcagcagccactcctccagagcctgtgacaacagccttaagcagagaattgtgagcaccagcattgccaccggcgggatcagccaccacgtccagtaatcggtgaaatagattcccgtaaaggaggatgcattctgtatcatcagcccccaggacttcgcaaggggatcggacagccccagatacgccagggaagactcctggatgatggtcctgccggtaactgcagccgcattgactaagagcagcggaagtatttcacccagcatatgctttctcacaatataccacggactggcgccgtagctctttgccagcaccacgtatttcctgttctttacggacatcaccttggcgcgcacctgttttgcaatggatgcccaggagaaggccgagacgatcagaatgatattccagatactctgtccccagaacgctccgatcacaatcataaccggaagctgcggaacagacagaaacacattggtaataaaggagaggaccgcatcagtcctttttccgcagaatcccgcgcatacgccgaacagtccgcctgcggcaaaggagcaggcggacgctgtcactcccgtcatcatgctcagataaaatccctttgacagctgggcaaaaatatcgattcccaggttgtccgttcccagaaagtggatggccgacggcgcttcgagggaggcgccggaagacttaaccgggctgtggggatacagcgtcaggccatacaggcagaccgccgccagaagaagcaggagtatgaaatatcttctgattcgtttcatctcaattcctcccggtcaatccctgcgttcagcacgtccgccagaaacaggctggtgagcaccagaaccgttgacagcagaaaaaatccctgtatcatcgtatagtccctgtaccgcacggcttcccgcatcaccagccccagccccggataagcaaatacattttcgatcagcagcgtaccgccaaccgcggttccgacattcaggaaaaaacgaaccacgatcggcgtcataccgtttctgaatatgtagctccagcggattcttcccgctttcagccccttggccctggcattcatgagatacggtttcgacatcacctccaggaagctggctctcgccgtgaagtaaaatccgggaaacatcacaataacgagggacagcaccggcagaaagccatgggagatcagatcccacgccttctccccgccagtctcgtatctggcaaatgccgtcgccccgcctgacagaggcagccatgaaacctttgccgccaccagaaataagagcagcagcccgactaaataagcgggcacctccgtaagggcggataatatccgaaaggccgcccagtcgaacctttttttctgcattccaaacagcgccagcgccgtaccggtcaccaggctcacgattaacgatacgcccatgacagaaaggctccagggcaggcgttccttaagcacagtagtcaccggctttttgtaatggatgctcaatccaagatctccggtcagatttttcctgactgtctgtgccaactgctcagcgagcggctgatccaggccgtaatacgccctcatctgatccagctgctctttcgaatactcggtatccatgtcctcgccggaaaccgatgaggtatacagaagcggatctcccggcatcaggcgtggaatgaaaaagtcaaacaggtaaatcaccagaaaggtacagataaacagtgtgattcgttttctcataaacgtttatctttccatgtaggacagacgggtctgttccgtctgctgatacgcgtacgtcttcatccagccgtcgtaataatccttgcggtacatggagtaggaggactgatttgcaatgacgatcagcgggacttcctcactgaccagatactccagatcctgaaacatctgtctgcgggcctcgaaatccacttccttcatctggtcctcggccagcttcgtgatctcatcgctgctgtagccgatcggtcccatgctgtgcggattacctcccttattcttcgaacggtcggagaaaatggttctcatatatttcggcggattattgccccagccgccattgcctaccagcgcaaattcatagtttcccgcatggaccatctcatcacgggaagccgaatcgtaggctgcaaccgtcacttttacaccggccgcctccaaatcctgtttgataagctctgctatatccacatcggagccgctgtcggccgccagaagggtcacttcatagtttttactctccagtgcggacttcgctttttccggatcgtatgggtaggccacaacgtgatcgttgtaataaaggcttccctgcggaacgtatcccgcgctacccacgcttccggctccgcggaataccttgtccacgaccgcctgacggtccagggccgcatacacagcctttctctggtccagatcgagaaaaccgggacatttttcaaaattaatcaggagcttgtatcccatgtcattggctttttccaccacaccgatccccggatcgcttaagtatttatcctttaaatcagccggcatgccggtgatgtcgatctcgtgattttcaaatgccagaaggggatcgctgacaggaacaaacagcacgcggtcagctgccggttttccgcccttgaagtcatcgaacgcggtgaattcatagcttccggtggccccgtcataggcggtacaccggtatgctccgctgcccgtcaaatatccgtcgcccgtgtaggtgttcggatcttccaccttctcccacacgtgtctgggaataatcacaaacgaaccgatgctgctcagcgtatccgcagcggcctctttcaccgtgatggtaatcgtgcggtcgtccacaacggtgtaatggtcgatcaggaagctgtctcccgctcccagcgagttggataccggcgggtgttccctgaaatagtctatggtaaaggcgacatcctctgtcgtcagaggcgtaccgtcgtggaattttgtatcgggaaacagggtaaacgtatagtcactgccgttcatttcccaggactgggcaagccatggaatatctcccgtctcatcttcgtcgatcaggcttgcaaacaccagattcatcttggcgcttcccgggccgcgggatgcgtttaaataagggctgggagctccccagtccgtccctcccgccagcttgagcgtctccaccagatggccctgtttcgtccggccttccgtatccccgttctccgcctcagcagcctgttctgtatgattcactgattctgacgcctgtaccgacgtccccgccgccggcgtcccctgctttccgcagccggttactgcggccatcgccatcatggctccaaacataaagctcactaattttcttgatctcattgcttcctccatcttatctctcctgtatttgtacccttcccagctgtctttactgcggcgattatgatgaaaggcccgtctcaccggaccgttccgcctgacataaaaaaagccacgaaagcaggcacctgcaaagcggtgcgatatccttcatggtattaagcttcatcttcatgatgacgttaggaatagtttatcatagattagtcacactttccagaatttttacacaatcgtttgcgtataaggagagaggcggatttccctcctctctcatcttcttctcacggtcaaatagaaacagttcattccatcccggtattccattccaatctttgctctgtgttttccagccgtctccgcggcgatagccagtcccaggccgtagccgctgcagctgcttctggcgctgtctcctctgtagaaacgccggaagatcagggaacgtttttcttccggtatgggttctccctggctgttcacccagagctttgcccgttttctgcctgccgcctccagcctcaccacggttttccctttgggaagggagtatttcaccgcgttgtctaaaagcgccttgaccagctgtcccacctgatccggatcgcccagcatctgcacctcctcgtccagctgatactccagctgcttttcctcctgatagaaaaccggttcaaaggtcagcaccttttccatcaccagatcgcttaggctgaagagatggaaggtccccttcttcggcgtgagggcgtcatttttggcaagcaggagcagactctccaccaggaaacgcatctccctgcattcctgaaggatgtgctccagccatttatccgcctcggcggatatgcctgtatactgttcctgaagcagctcggtgttagccgtgatcaccgtcagaggcgtcttcagttcatgggaggcgtcggccacaaactgcttctgcatccgtatggactcttccaccggcttgacggcccatcgggaaaagaagtaggacagcaccaggaaaccgatccagataccggcgcaggccaggcctccgtactgcataacaccgtttcgcagggtgtcctcataggaggtgtcggcaaacgcgatcatatatccggtggggcggctgacccgcagataccggagatggtagccctccagaagccccatgtcctcctcgccggccattcccaaaaacgccatctcctctaagaattcctgtcccggaaatgcttcatagccgccttcccacggagtcaccatgccatcctcccccaccataacggagaaatacggcgtctgcgcaggcgaacgggtggtgaagatcaagggatgctcctcctgcgacaccaccttcgccagcgccagccttccctgcgcgctgacccgtttctccatgacaaatgccaccgcacagaaggtaatcccgatgaccgccgtcacgatcagcatgttatagcagataaatttcatccgaagcctgcttatctccttcattcccgtccgcctcctccattcttctccatgatccggtatcccagtctgcggatggtcacaatcaccacatccgcattcaaaaactccagcttctttctcagaaatgagatgtatatctccacattgttatcgaccgcctcgccgtcgctgccccagatcttcgaaaggagcgtctccttggaaactaccatgtcgcggttcacgaaaaggatccggaggaggtcatactccttcttacccagccggatgcttttttccggcccatttaacgtatagtccgcctggttcagcgatatgttgcccaggctcaggcattccgggatcacctctccccggcgccgtaatatcgtcttcatcacggccagcagctcctgcatgtcaaagggctttgtcaggtaataatcggctccgctctccagccccagcacccggtcgtcgatctcgctctttgcagtaagaatcagcacgggaacggaacagccgctctttcgggcctttttaagcagtgtgatcccgtccattcccggcagcatcaggtccagcacggccgcgtcataaccgccgtccgtgagcaaaaagtatcctgtattcccgtccccgcagatatcacagtcataccagtgtttcaggatgtcacggatggattccgccagccgccggttgtcttccacgatcagtacacgcatttttttcatctccttataacacaaaaatccatctgtattctctctcaattctacggagaatgcaagagaacaccgatggattttacagataattcacaaaacagcgatttatcgccctaccgtccccggatttcctttctcataaagctgatataggagacggcaaagactacggcggtcaatgccagcaggcccgtcaggtgcggccataccagcagcagactctgtcccagggacaggtatccgtttatagcgcccgacagctgctgcggaagtatgatgttggtggagcgcacctgcggattcataatggtcgataccgcctcactgtacagatagtacggggagagccggttcaaattcatctggcagttataattagccagaatctgcgatgcggtcgctgtctgccccatggggtaaagtacgttggctgcgatgctgacgaccagcgtcataaacagggcgaaaaagatccacagcgcaatcaccaccatagccgatgtggccgcatggcggcacagcacggagaacaggatggagagcgccagccagaaacagatgtagacggaagtaaagaacagcaggacgagcacccgtcccagttcctcccccgatggcgggattcccgtggccagcagccccaccgctcctgcgatcagtcccatggagaagaccatcagaaagatgatggtggctccggccagaaacttgccgttaatgaccgcatcccggtaaatcggctgggccacaaggcggtttaaggttccttccgagtgctcgctgttgatggcgtcaaagccaagcgccagcccgacaaaggggcctaaaagcgcaataaacgaggtgaacgaaggaatggaattcccgctcaatgtaaacagttttaaaaagatgtagccggagtcagacgccgtctccgaggagaggctggaaagcgctccgtaaatgctggcacagctggttaaaaggattaagagcagcacgatcaggaaccgtttgctgtgaatatggtccgacatctccttgcggtataaggcgcccatgccgctcattcccgaacggacgcctccgcccgcaccgtcactcctctccctggcgctgttccctgccgaaagaaaggaagcctttacttttcctttgattgagactgccatttcccttctctcctttctcaaaatacgtgcggtagatctcatccagatcatttcccctctgcctcaaatggcacaggctgtagccgccctccagcgcctttcggttcagttcacggcttaagtccgagctggaatagatcacatagaaatccccgcttcgctctatttcctccacatttcccaagtgctccaggagctctttaaagcccctgtcgtccgggatagccgcggcctccagcacataatgtccctcccggcgcatctgcccggccagatcgtcgatccttccgcaggcgatcagctgcccctctacaaacaggcccacgcggtcgcacacctgctgaatctggtagagctgatgcgacgagatcagaatggtccggccatcctcctccgccaggctccggattaaaaacatgagttctctcatcccctccggatcgattcccagcgtcggttcatccatgatcaccaccttggggtccttcatcagtacatccgcgatccccagacgctgcttcatgccccgggaatacgttcccgtcttctggtccgcagccccggtcatgccgactttctccagcagatctccgatccggtcttcgatcaccttcttcggcagcccgtttaactgccccgtaaaccggaggttctcccggccggtcatatcggaatagaagcccacgttgtccggtaaatatcctaccatccgtttcacctcgatggcctgtctggtgcagtcctttccatcgatcgaggcgctcccggctgtcggctccgtcagacctaagagcatcagggtcgtggtcgtctttccggccccattgggccccagaagcccgaatacctctcccctgcgaatggacagcgacaggtcgctgaccgccttcttttccccgtaagccttggttaaatggtccgtttttatcatcatttcatcttcataatttgcagcaatgtccataacaatgacccctttccggcgtgacagccctttcggctatcttctgccgtatttacggaatacgtagcccagtccgcctgcggtacacaggatgattacgaccgccacgatgccccagatagtgctggtcttcacggacacacggaaatccgcgctggattccgcctgctcacattttgccgtaaaggtattcacatagtctccggtgatggcctcagagcccggttttacgtgggcgatgacttccgtcgtggaaccggcgggaatggacgggatcacgttgttttccaggttataggttacggtccatccggatggcagggaggaatttaaggatacgtcctgtaaatccacattgcctgtattcgtcacattcaaggttacgtccgattcttttcccgcataggcgtcaaagctcagccgcccatccggcgttcccaccttcaggccgtagctgccggtgatcaccacctttaaatccgtgctgagagtctcctccgcggaaaccgcgctgcatgaaatatcgtattctccggcggcgattccctccggcggtgtgacggacacggtcatgcccttgctggtgctggattccacctcgatcgccgccacctttgtggtctctcccgttggggtgaagctcacgttccagcctgccggcgcgttggaagagaggctgtaggactggctcttcagtccgttgttaatcagcgtggtgctgaagctgaagttggttccggtggttccttcctgctgcggatactccgaggtaaagcttccctttcccgccttcatctcattgacaaggaaggagatggacagtgtgtcggagaggccgcttgccgaggaggcgcctacctcgactacgtaggttccctctgtcagttcctttggtacggttacatgaagcgtcatttctgctccggcctcgccgttctttacatggatgcggcttacctggtaattaccgccctggaggtatccctcccagccgtcgggcatggcggacactttaacatctgcatccagaccggagccggtgtaattatccagtgtgaccgggatatttaagttatccccgggcttaacggatattccgggataatcggtgctcagcttcaggccctcggccgcatacgccgtatgtacattcaggaacaggaaaagcgccgccgccagaaaaacagccagaaatgcccatacccttcttttttcgtttcgtttgcttacaattgcttcctccataatatcctccttttgatgcgtcttcggcatccgtatttttcttaagaagatcatatcgaagaaacctttaatgaacctttaataagtttgaaaatactgtgaaacaaagagacggcggcagaacgtttttcatgcaacgttctgccgccgtctcttttataagccgcccggccaggttcccgggctgtcggaccgcattaatcgttatcgggcaggagctttatggtgaccataatgtatttcaggaaggctccctcttccagctttatgtctgtcggatgcgtctggtttggaaactcgtaggttccctcttccacctccagatagagccagttataagccgcctctctcgcattctccacagcatcttccagatccggtccgtccgcctcacagcactttaagtccggaaattccacatgatatcccttatcgtccctatggggcgtaaaaacagcagggtaagtaaatgtcataatcgattcctccagcatatatgataaacagtattattatatacttattctgccccattgtacagatttttatcagaagcttcttcgtcactgtacacgccgccggctgccgcctgttctctcagcaggctgataaacagaccgattgccggcgtaacccacttatttttatgataggtgcataccgtggtgatcctgttattctctatggaaacgggaagctcccggatcagcccgcaccgcagctcctcctccaccgtaaaacgcggcaggtaggcgacgcccagattcccggcgacacttcgttttatggcttccgtactgacaagctccatctctccgttcagggtgatgtctgattttctcaagtattcctcaaactgtctgtggtataagctgtttttgtccatggtcagcaggcagatatcctttctctggcccttcgttatgaaatcacacgcttcctgcttcagttccatgctgcctgctaaaaccagctggtagtcacgcagcttctcgacaacgagggaggcaccgtaaccgccgatatcgtaatgcaccccaagatccacgatgccgctgatgatctgctcacgtatctcgtagcagttgggcgtccggagagacagctttacatctggggccagtttgcgaaacgcacttaagacctggtgcatctgatacgacagcagcgtctccggcatggcgattctcagggtgccagccagcagatggccgcactttccgtaattctccatctgccggacggcctccaaaaccgcgtcgatataaggcagcagcccttccccggcctgagtcagctccatcctccgtccgattttttcaaacagcttgacagacagttcctgctccagcagctgcatctgcagggtgatggtggactgagcgtaattcagccgctccgccgctttttgaaaactgccggtctcgagaatggttttgaaggtggttaagtatttcagctccatatggtgcgcctttccaagatagttcagtaatatcgaattataagtttcttattatctattagaccgaagcttctttttccgctattatagtatagagaaggtggaacgtcaagaatttacagatcattttagggaggtaagatattatgatagaaatcagaacctattccgatgaagacagggaagaggtgatacgccttgtcctgcactgccagaacgatggaacccgcccgtctgtgtcggtagacgatcagccggagctgcgccgtattccggaaaagtatatggacggcggcggtaacttctgggtggcaaaggataacggaaaaacagcgggcagcatcggcctgatgaagtttggcgatggaaccgctgttttgaaaaaattctttgtctatgagccctaccggggcgccccctgccacctgggcagacagctttacggaactcttctggattatgcgagaacccacggcgtgaagcagctgattctggatacgccgaaaaatacggaccgtgcccataaattttatgaaagggccggatttacgaaaatagagagagcggacgtaccggtggtttatgactttccttatgaggacagtgattttttccggctggaaatctgatccctcatcagcctttcaaaatctcccgcgggcataggcctggcaaaataatagccctgcacatagtcgcatccggtctcgccgagacgatccagctgttcctttgtctccacgccctctgccaccacgcttaagtgcatccggcgggcaagctccataataaactgcagcacgccctgatccgcaggtttcgccgtctcactccggataaatgtcatatccagcttcaggatatcgatcggcatctgattcagcatattcagggacgaatagccgcttccgaaatcgtccatttcgatgacaaagcccagttcccgcagatggctgaccgtctcgatgatctgtcccgggtcctccgtgtaggcgctttccgtaatctcaagatggagccgggaaggcgtcaggccgtatttactgacggtgcgcatcatgatatccgcaatatccgcgtgatagatatccgcacgggatacgttcacggagacaggcacgggcgggtagccctcatcgtcccatctgcgcagataacagcaggtcttatcccacacatactgatccagttttgtgataaatccgttcttttcaaacaatggaataaattccgccggcgactggaatccccattccggatgcttccagcgcaccagcgcctcggctccggccatggtctcatcacagatcctgtatttcggctgcagatagactaaaaactggccttcttccagagccgtctccatgctgtctatgatggcctgctgccgcagcagttcatcccgaagcttatcatcgtaggcggcaaaatagattccgtactggcccttgatactgcgcgcggccagaagggcgcggtcgcacatctgatccaccgtcaccgtctggctctcgacggaataaataccccatttcaccgcgacatttttagcattctgaagcttattgatctcatcactggaccggataaacatctccgccgtaaactcctggtcaaattccagcaggcacgcgaactggtccgcgctcagacgtccgcagatcccgcgttctcccacctgtctccggtacatatccgcaatcccgcacaacagccggtctccggcggccacaccgaatacatcgttaatcagcttgaaattctcgatatcggagcagatgatgtaatagttccgccccggattctggcggagagtttccctcacgcgctgatagaagaattccttgctgtagaggccggtaagccggtcgtactgaaactgattgatcatggcggcggtttcccgtagatggatgatgctcgccacccggtgccggataatctggggcttatatggttttgccacgtaatcggtggccccatgggacagggccgccacctcatccgcctcgctgtcgctctgcgtcgtgacaatcacagggatggaggccagggccggatcggccttcgcaatcgacaggaacgtatatccatccatcacaggcatagtgatgtccagcagaatcagggaaatctcatcctttcttttctccagaacctcgagtgcctgctgcccgttttccgcttccagaaccgtatattccggagagagcagctcacttaacatcaaacgattgatttcattatcttccacgaccagaatagtcttatttgcgggcatatattatttcctcttttcttcaggctgccatggacagaaaggtacaccggctgctctgtccatgaccggtccagtttattataccaaaagagactgctcagcacaagtgatcttctgcaacacatgtcaaatattctgccacggtctcatacagcagcttcccggcgggccggacagctaaacaaaagaccccccggttcgatcacacgaaccagggggtacagctccatcagtattttctgctccggtattccgccggattcattcccgtctcttccttaaacaccttgctgaaatggcttacattgcggtaaccaacctcctgcgccacatctccgatcttttcatttccttcccgcagctttctcatggcaatttcaattcgcagctttctcaagtattgaacgaaattttctcctgtatttttcttaaaatagttgcagaagtagttctttgacatatttacgtaatcggagatttcatccaggcttaagtcctcgccgtagtgcttgctgcagtaatcctttaccatgacaatcaccttgtctgcacctggttccgcctcgtgatccggcgtattctccccaaagatctggatcagaagcccctccgtgtaccgtgccagagctgacagcgtcgtatatttcttcaaatcttcaaccgtaagattatccagagcgtaccgaagaccaccgtctgttatggggatctccgcctttatgagaaggagcagctcatagaccgcctgatagaccagcctcggacttacggccatctcgtccttccagatccggacgcactggcggaagtaggcgatcaccgcttcccggtccttttcatggagccattgtttgacgatcaccgaatcaagaagaaaattcttccgctgctctctgtaaaatgccgcctcgccgcacttgactatcttcccggtgaaatccatataaaaatggaaccactccgtctcccttatctttttaaagctctgatagagttcctggtaattatggcacttctctcccatgtagatcacggcgggaatccctgcggtatcaagctcttttttcaccagggccagctggttatacgcaccgccggccggaagcagaaggatgagttcatccattccctgctccgcgcaaagaatgaacttttcccgaaacgcgcttaaaatatccctggccatgccgtttccttccattccgccgtccatgggcagaagcctgatctgtgcagtcaagaactctctcggaagcttcagctgcatggcttccgcctcctgctttgcctcctccgccgaaagctttccgttcaagaacttgagaaagacgctctttcccaaatccggaaggatctccccatacttcttctgcacctgctgcgcggttctctccctgtatatgcactccgcgagttccttcattgtctttttgacattctccacattgatcggtttcagcagataggcatacgccccgtaattcagcgcatcgaccgcatactcgaactcacggtaggccgaaagcaccacgatcttcgcagtgctcccccgctctttcagcagctgaatcagtttgattccattgatgccaggcatgttgatgtccaccacggcgatgtccggctctatgcggccgatcagctccagcgcctcttccccgttcccggcgtctcccaccacctcgatctccgggcagcaaaggggaatcagctttgtaagcgcctcaacggtcagtaattcgtcatctactacaacggctctaagccccatattccttctcctccagtcccatacacagacggacgctgcagtaacggccttccagtgaacgaatccggatgccgcttcctgaatcgtaattcagcttcagcctgctgtgaacattcgtcaggccaatatggcccggcgtctcctgcccctctgccagcatctcctccagctgtccgagcctctgcgcgccgatacccacgccgttgtctgttatggtaaaacagattctcccctcaatcacttccccctgtatcagcagctttttggcacccttcttttctttgagaccgtggcggatcgaattctccacgaccggctgaaggatcagcttgggaacccggtaagaaagcatcagctccggaatatcccgcttccactcaattccatggttaaagcggatattctggatttcaatgtatcgctcgatatactccagttccttcgaaaccggcaccatatcggacatctcatacaggatgtaatcgaacattccccggagagagtcaatcgcaaaaataatctcctgattccgcccgagaattgccagagaggtaatcgactgcagcgtattattcaggaaatgaggattgatcttggactgcagcgcctccagctccgcctgctgcttgctcacccttatggcgtacacttcattgatcagattctcaatctgctgtgccatatgattaaagttcttattcaggatatcgatttcctcataaccgctgttttcatctacctggatatagaattcaccctctccgaacttcttcatgctgtcactgagcgtccgtaccgatctggtacacttccatccgatatagacggagataaaaataaccagagaaatggcgataatgcttgtgatcacggtgaaatggcggatcgttgccaactgtttctttatctccgacaggtcaatctggtaagctaccttccagttattggcctctatctttgcaaaggaaagaagcatcatattatcgatctcattggttgcactttccggactccagtcgtaatccgggcacggaaatgtgctgctgggcgcataaaacagtttgccctttccgtcaattaagtaacagccgtactgctcccacagctgctgcctcttgcatattttatcgatccggtcaaagttcaggacgtaaatcatcgtggccagcgtcttgctcccgtccgcatccttaatggggaagcagaccagcatctcctcttttccgcttcctccatagacgtagtctttgtttttcgccgacaaaaactccatattatacttcttcatctcgtcacaccggctgacaatctcccggatcaggtccgaaccgtaattcacattgccaatccccgaatcctggcagttgaactggaaattgtccgatatgataatgatattgtgaatgtcgttgtcattcagtatggcctgcttcatcttcccctgaatctttctgacgtgctcatagcgctccgcctgggatttccggttgcattccctgatatcctcccgcagggtgatgtcgctccggaagaagttcatggcatttaccgcgtcctcaaagtatacatttaaactgtccgcgatctggctggtcagcagaccgatctcttccatcttctgccgtttcgccatcgaatacgacatgcggtaggatacactgcttaaaacggtaatcgcccccagtatcagtagtgtatacagtataatgatatgaaatctcatactcctgaaaacatgcttaaaatgcctcacttctcaaagtcctcctcccggctgccatacagaatgctacatcgggttagtgcctcccggcgtaaatacgccatgcatagcacccgctctctacgccagttgcacgcctgcgaagctagccgtaggccccactacgccgtcgcttcgcagacgcacacctgacgcagatatcaggcactatacaaggcgcatttacgccgggaggcactagccgtctgaatcttcaatagaaattcaaactggcactcgtcctcgcaccacatactgaaattcgtcccccagcggttattaaataagttaaaatagaatccattttccaggctgtccgtcttctggtccatctcatacagattacggcccccgatgcttaccagaggcgcatggatattctcgaccgtcacgcttccatccgcgccgcggtactccatcgcctccacacagtgctgcttccggttcccgcccttaaccacgtcaaacggcgaaacctcctctcccagctttctcatcatccagcggtacggattctccacatcgaactgataatggaaccagagtgcctcaggcattttgttggcctccttctgaaaccatttcagggtgcaccgcacctcattctcatcaaactggtaaagaatctgcgcttttgcgggacagccgtacttacggaccgcctcctcatcgccccgcaccgagatcagaagcgtatcatctttttttgtaactgtttctgcataaaaatcgtagcaccggttctctaagtcttccacaaattccaggcccggtttcgaaaaatctccctctgaccacccataggtctcatagaaatcacgattataccgatagtaattatccacgcagtccacggccgaaaaggtctgatactgaagtcttcccgcttccccgtccttaatccatgcgcggccgtctttctttaagctgcatacagcgccggtgccgtcaattttgacagaccagccctttacggtcacagtctctcccagccctacgagttccccctcgtgtccgctctccaccggtgtcatccgttcgagggccgtcctggcttcggcctttaaactgtcaggaagtgcttccaccgccttttctaaatagtccctctgctcctggtgggatgactcataataggcgtaggaaccggtaaacacgccgcctctgtaatttttaaagtccgtattcagtatatccagcatgctggcattccggtacgtcaggaaatccagagtcgtggtgtcttcccgccttgccctgtgaaaatcttccttcgtccagttcttaaaatctgccagatactttttaaaatccagcccccacgtatgctctgccaccagcatgagattcatgaagaactcctcacagtccttctgtccgggcgtcatcaccccttcccgcacccagcggtccttcagccttaagagttcccggtatctggttgtcttccagggatccgaggcaattccgtgaatccaggagtcgccgatctcttcctccaccaccggcagaagcccctttctctcccacaggctttcggcgtatgcgtcaagggtggaggccaccacccgggcattgggataaagcccgcggatccggtcaaattccttctcgatggcctctgccgactgcggccccaggttatcgcccgtatgggcaaactccagaacctcatccatgccttccacatatcccggagcgccgtatgtgccggaatactgtacaacgatctcccggttcccctgcttccacaaaaatgtatcgggaacctccggcaccatgcttgacgcattgacaccgatatgaagataccggatgccgtgatcacacagcggcgcgatcagccccctggtatgtcccggcacatccgtcatcttggatgcgattgtcgttctgccaaaccgctcgtccagatgctttccgatatccaggctgtagtttaataaatcccggtccagcagctccgtatgggtggtgcaggcaatgccatgccagcagatatcccctctcccgattgccctttccagcagctccacagcttccggctccgcgtgttttaagtagtaatcgatcataaaagatcccagcgtccagataaatttcttatccttttctgtattcagttccatcgccagtttcacagagtgaggaatatactccttcacatatcgctctgttacacggcttcccatgtcggtgaatccaatatccaggtgggttttatataccacgtgtacctttttaattgttgaatagtccatgatttctcctttcgtcaccccttcacgcccgatgacacgacactctctataaagtttttctggaatatcaggaagacgatgagaatcggcatcatcaccatcactccgcctgcaatcagcccgccatagttgacggaattgtccgaccctttggccaaatgcgccaggaccagtgcgagcggccgcatcttttcctgtgtgataatggctctcgaccaagcgaattcactccagataaatgtaaacgccagaattgtaataccggaaactgcgctctttagcatcggcagtgccacccggaaaaatgtcatccagttgccgcatccgtcaattcttgcggcatccaggatctcatcgggaatataaccggcaaactggctcatgtagatgattccaaatccgctgtaaaggaagggaagcaccaggccgaaataattatttgtcagctttaaccctcttaccatatcaaaaagcgggaaataggtcaactcccccggaatcatcagtgtcatcataatcaacagcaggagccattttttgccagggaaccggtatttgctgaacacgtatcccgtaaccgtacttaaggacacctgtatagatatcatcaggagcgccgagatggaagacgtgataaacgcgtcctttaaacctcccacggtaatggcaaaggagtaattttttaagctcgcctctctcggaatccagttaaacggtaccttgaaaatctgtccctggccctgaaaggacgcggaaaccatccagataatgggaaccaggaagataaatgccacagccatcatacagaccagcagaagcagctgcttaagttctgatttctttttcatcttatcacctaatcatcataatattttgtcagtttcatctgtatcagggaaatcaccagggttattaagaacaccacgaccgcgatcacagacgcgtatccgacatttcttgactggaagccctgtttaaacatatacatgattatcgtctccgtcgatcggtagggaccgccttccgtcaggatttccaccagtgcaaagctccttaaatacgttattgtcgcatagatcatggagaaaataatggttggctttaactgcggtaccgtgatgtaccggaacacctggactccgtttgcgccgtccactctggccgcctcgtagagctgcctgttaatgttggacagaccggccaggaaaatgaccatgtaatatcccgttccattccacacatggacgatgatgatggcggccagcgcccatccggggctgatcagccatccgacggaggggagccccagcgtattgagcaccgtattgatcagtccggactccgttccgaacatcagtttgaagatcacgctggcgacgaccggaggaaccagaaacgtggcaaacagcgcactccggataaaattcttccctcttttcatcgaaaagacggccagcgctgcgcccagcgagacaaccagcaccagaggaacgctgaagatggtgatcgcaaaggtattgaacagggctctgtgagccgtactgtccgtgataaactgctgtatgtttttaagccccgaaaataccggcgcctttatgtaattatagtcacagaacatgtaatacacattcttggcaaatgggtagtagacaaatatgataaaaaacagaattgccggtattacgatactccacacgaataccctgtcctttaccgttcgtgataatgatttcatgctctcattccttcctgccttttataaaagcggcggtcatcgatgcttcttccgcatgtgactgccgctttctgttcttactgtgccattcccttattgatctgcgctgctgcttcttccagtaccgtctttacatcttcctgcttgatgagaatacgttccacggcggctccgtagatattggccccctccggatactggtaaggattgtccaggaatacaaattttgctgtctttaactgctcctgctgtaccttcttggactctgtaaggccgctttccgcccatacagcctgcttttcagggttatcataaatcgccaggtctgtgacaccgcggtcggcctgtatctggaattcctcagaatacatcagttttaagaattccatggccatcgccttgttctcagattcttccatgaccgcccagtcacatccgccgatcgggccaacgctcagtccgtctttaccggtcggaatcgtggcatatgcgacatcaatccccgcatctacagtgcccggaatattccattcaccagtaaaatacgtcaccatctgtccattgagccagagctggtcacctgttccatcgggaatcggcgcccatccgtttttcacaaaatcctgcatttgaatatgtgcctcaatggattccgtggaatcaatcactacctgagaatagtcctcattcatgtactcggctcccatggagaaaacccacggtgataattcccatgtgttgttggtaggaatattggtagcgtagaccttctgtccgtcttctgtcgtaattccttccgctacaatcttctcgccgatcgcctttaaatcttcaaacgttttcggaacctctgctccgatcttctctaaaagttccttattatagaacataaacatggtattagtattatagttcattgcacagatctgatctccataggacattctctgaagctgtccctcggtgaggcgcggatagatatcccagtttttcacttcatcggtaagatccatcagcattccatctttaaagaactcctgggcccatcctccggtttttacgatatccggtatgtcacccatgctcaccatcatgatctgcttttctctcgtctcattccaggggctggtaatcagctcgtactccacattcggatattgttccttgaacatggccatggcaagatccagattatcgtccgtctctccggttgtggaaatctttaacgtaaatttctcgtcgcttcctgccgcgccgccggcctccgttttgcctgctgctgtctgtcccgctgttgtctggctctccgcagtctggcttcccccctcattcgctccatctgttttggaagaacaaccgctcattgtccccaggcaaagtgccgcgcataacgctgccgccccaattctacttagtttcatataacctctcctctctttgtgctatctatcttaattacaattaaattttagcagtccttttgtgtttttttaatataacataattacgatttttaccgcaatattaatattttaccatttcagtccaaatttacagctattctttgcacaaaaaaacgagacccgctttgcatccggcaaaacagatcccgtttttcttatactctctgataaagctcggcagccgtatgggaacgccgtgccagctcctcttttttcataatgcaatatccgctctccctcttttccagtatcccctcttcacagagctgccccagcagccggaacatatggcgatagctcattcccacggagcaggagacatccgtcagcgtatcgcggaagaggctccggtgagaattctgaagaatgtaggcgcaaagccgctgctcgccggtgcataacgcggtcgatgtaaaattgtctgaactggtagtcagcttttccgccagctccgttcccagtttattcaggaacacaagattcgttttcagttctgccaggcagttctgataggaaaccgcaatgcactcaaaatccgtgaccgccttcacggaacaggtggcattgaactgtcttgccatcagttcgacctcgccgatcaaaccacgggagatgttgtagcacaggatcaggctcttgccgttcggtgctgtgcggcagaccttcgcattgccgtcgacgacaatagacagccagctgataggctgcccctcatgcagcacctcttctcctgccgaaaaccgcagacaacagcaggcgttcagcggaatattctgcaggccgtattctgccagacgggcggcatgttcttttctcaatgggagtcttttcaaatcgattacctcgcttaacctgattatggtcttactgtttattataacagaaaccggaaaaaataccatgacaaatgtcctacatggtagggcagatattctgttatcctcatatcaggaggtgaactgtcatgtatcagcttttagcccttatcaatggtattattctgtccgtgatgatttccgtaaatggaaatctgtccgttcagtacagtgcgttcacagctgctgcgattatccatgcggtcggttctttgtttgcgctgctgctctgcgcttcacagaaaaacagaaagccggtctggactcacaggcccaaatggatttatctcggcggtgcaatcggtgtttttacaacggtatttcaaaatctggccttcacctatatcagcatcacgagcgtgatcgccctgggacttctgggacagacagttacgtccctggtgatcgacagttccggattgtttggtatggaaaaaaggccgcttccccggtatgcatttatcggccttggtttatcggtgtttggtatctttgtgatgctggatacctctgtcacgacggctgcgctgggggctgccatctcctttgcatccggtatttccatggtgctgtcccggaccgccaacgcgcggctggccgagaaaaccggggcgctgcagggatcactggtgaatcatctggtgggacttccgattacggtaattctcgcctttgccgtggccgcagcaagcggaacctctgcagccgcttccgcgggaggcagcttccgcccctggatttacttcggcggcgctctcggcgtcgtggtagtaatgctcttaaatatcacggttccgaagataccgggattccagctgacgcttctcgtcttcgtcggccaggtcttcaccggaatccttttagataccgtggccggcagctaccagaccggcgccacgctctggggcggcatgatcatcgcggccggaatcgcggtcaatatgatcctggagcgggttgttgcagtttcaaaaaagacaccgcacagcagctaaaaaatcagctgctgtgcggtgttttttcaattctggctgctgtgcagcacaacttcaatcaacttgcagagcgactcctgaaaccgctcgtcgtcgtcttccgtcctctttgccggccccttcagatggtgctttccctttcccatacgggccttcttggccagatggcgttccatcagcatctggtcgatattctcgttggtgtaccattttccgctttgatggattccatgtgccccctttcccaggatcatggccgccactccatagtcctgggttaccacgatatctcctttgccgcactgattcaccagcgcaaaatccacggcatccgcgcccgctccgatgacctttatctcgctgtaggaagactgaagcacatggttggtgtcacataagagcaccaccggaatcttatagcgctccgccgtctgttccacaattctcactaccggacatgcgtccgcatctactaatattttcattctgttatctcgctgactttttcctgaaatacgttatactagatgatgattccatttaaatggtcgcactcatgctgaatgatctgcgcgatccatccggaatacttctggcggtgcttacaaaaatgaatgtcctgatactccacttcgatctcctggtaccgggtagtcctgcggactccctccagcgacagacagccctcttccgcctcataggggcctgtccttttgacaatcaccgggttaagcatggctgcattcaccattcccatctgaacggcaatcacattctttctgacaccgatcatgttggccgccatgcccacacagtggtcggtattcgcctgcagggtgtccagtaaatcctgtactgtccccaggtcatcctttgtcgccggctccgatttctgtgccagaaaaaatacatctcttacaacggttcttaccatattgattcgctctcctaagttttgattactgtgttaaatcctgattcagccattcttctgttttcttaaaaaatgcgtccaccagatccggccggtcgatgcctggcagttcgccgtcgatctcataaccggcgctgtccccacccagccatgcagtcttatctgcggcttacatctgtaacggggacagacatctctaaaagtgtaccgcagaatggcatatccgtaaagaggataatactctttgtaaggatatttccccggtaaaggtcagaaaccacggcgatttcggcctgacgtgccagctgcctttcaattcaatcaccggtcaaatatatgtttattggtacttcggatccgttatcacttttgtgttttatggcattgtcttagatggaataaaaaagaaaccctccacttacccaccagcctgtatctgtgtgctattctcttctcacaacaacgagaggagaaaatggtatgaaaacaacaattcaggtatccagtctttcaaagtcatatggtgcgctgcatgtcatcaagaatcttgatttaacggtatccaaaggtgaagtttacggccttctcggcgctaacggcgcgggaaaaagcacggcgatcgagtgcatgctgggcacaaaaaaagccgataccggcagtatttccattctgggaatgagcccgcaaaaggaccgcaggagcttatttcagcaggttggcgtgcagtttcaggaggccaattatcctgacaagatcagggtgagcgagctgtgcgaggaaacagcctgcctctacaactgtccggccgactacaccaaactgttaaagcagtttggactccaggaaaaagcaaagaattttgtcagcgaactgtccggcggccagaaacagaggctgtttatcgttctggcattaatccccgatccccaggtggtattcttagatgaactgaccaccggccttgacaccaaggcaagaaggagtgtgtggaagagccttcaggagctgaaagacagagggctcacgatcttcttaacctcgcacttcatggatgaggtggaagagctctgcgacagaatcggtatcttaaaagacggagcattcgcattctgcggaacaacagccgaagcggttgcgttaagcccgggcaatacgctggaggaggcgtatctgtggtttacgggagaggaggctgacggagatgaataaattttttacgatgctgaaaaccgagttaaaactctccttccgtggaatggacatgatcatattcgccgtctgtatgcccgtggtcgtggttatactgctggggattatttacggtgggaaaccggcttttgacggcgcggactatacttttctggaacaatccttcggcgcagtctccacaatcgcagtctgcgcgggcggtgtcatggggctgcctctggtaatctccgactaccggcagaagaaaatcctcaagcgctttaaaatcacgccgtccagccccgtccttttactgtcggttcaggtggccatttacatgatctattccctgatcgcactggtgctgatctatctggtgtctgtactgttattcggcatgaagctgcagggagccttcctaccgtttatgggcgcatttttccttgtcatgatctccatgttcagtataggaatgctggtaggcggcgtgtctcctaatacaaaaattgcaagcgttcttgcaagcttactctatttcccaatgctgatcttttccggcgccacgcttccgtatgaggtgatgcccgccgtgctgcaaaaactcgcagacctgctgccgctgactcagggaattaagctgctgaaggctgcctccctgggcctgccggctgaaaatgtgatggcttcccttgccgtcatggcggtgatcacggtagtctgcggcggagtttctattcgatttttcaaatgggaatgacaggcggagtaaaaaaaactggttgagcgcacaggctcaaccagtttttttactcacgaatcattcgtacccatttctttaacccgtgtttcttctgcatcttccattatatccctgagatattccccgcgctgacaatattctgccagaaattacagctgcacagcgcatggctgccgtcgcgctgatccggcgcataaacaagtctcttctcctccagctccggcaggcagccggtctcaccggaaagatactgggccagcctttttccggcatattccaggcgcgccttcactccggccagtctgatatccagcacctcgtatccgaacaccttacactcctccatccagattccctgtctgaggtctgcaagtctctccgtcagtctgatacaggccggaatgccgttctgttccgcttccgccagataatccctgtctccgctgtgatagctgtcatggatccggatccccagttctgctttctgttccagaagccgtgctaaaacctcgtagtactcaaacagcacattggcgcccgaatggcggctcctgtactcagccagttcctccgccagcttctgataatgttccgtcagtcccagatcacgaatctgttcatcgaacaggcccagcataacgtcctggtagagcaggaacttggatggattgtccgcgtaacggttattcttaccggcaccgggaacattgtcgaaccgatccagaagccaccatgcctccctgccgtcgccccagagaaattccatgtaatcgccgtccgccctctgttcttcgccttgcaaaccactttctccggaaaaacaggcttctgcaaaggttgtgagagaaagatttccggccgtcatcggcgtctccgccccattgtcctgccagaatgtacagatcacctctgatacaccgttctcccggcatgcttccagcgcgggcataagcgtcgccgccatccaggaataattcggtgcaacaccgttccatatccacgcaccgcctgcaaacagcgtctggtctgacagtttcttatgaagcttgatataattctcatagtgttttttctcatcgtgatagtaatcccagtagaccatcgctgcgccttccggaatttccggcagatcggaaaaatcggtctccggcggcagatcgtagtaatcgccgctgggggacttcagacgaaaatacatatcactccagatcatcggctccatcccgtatttccggcagatggacagcacccgctgtaagtggctgttcatgatctcgaagcggttctgatagccatttttatttaagtaattcccgaggcccagttcatgcgcctcatccataccgagatggacacgcctgctgcggaaagcggaggacacactgcttatcatggcatcgatcagcctgtagacctcatcgtcgccggcaaggagaatgtccggcgtatcagtcagcccctgcatggtcttccatcggagcgccgtatgcagatgcgccagcgtctgaatgcacggtacaatctcgattccaaacagttccgcatagtcatcacaggacttcagttcctctctcgtgtaacgtccgcggaaagcgccaaaatacggatactccgggacctcatacgtctcttccgtatacagcatcataagattcatgcccagggatgccatgcgtctgatgtactcttttattttcccgacctttaatacgccatttctggaacagtcaagcattgcccccgacgactggaagcaggcactttcccgcagttctaattcctgcagctctaattccaaatctgccccatgcgtctccagatattccagcgccttcataaaacctctgaaaaaatggaccttttccctgcatctgattgttaagacgccatgtttcaaagagactgaaatctcatgttctccttcctgttcccagcagatgaccggctgttcccttacagcggtgctctccccatctgtcccgagctcatggccccgctcctcaagcagcagctccagcccttcccttacatttgccacactttgatccaatcgaaatttcattttttagtccttccctttctctttttcttcctgatataccgcccggtattccgacgggtagattcccgtatttttcttaaatattttggaaaaatacaggggatcctgatatcctaccatccccgcaatatcctttgaagtaatattcggatacgcagtcagcagctcctttgcattgttcagacgaatattctggatgtactgcgacggcgtcaggcccttatacgctttaaaaagtctgctgagatacggtgaaaccagaccgaatctggcagccagcatcttcgtcgtaatctgtgcatccaaatgggccagaatgtattcatctacctcccgcatcagattctttccttcctccgccgattttcccatgctcatgtctttcacatataaaagaaattcatcaaacacctggtccatatccgcagcagaggaaagaagttccgcaatatccggaaatgtattattttcctccggctcatttcgctctgcggaatggactgccgccatcagaaacagcttctgcaaaatccgttccagctccgtctgcgtgactctgaacagcttcatctggtctctgacattcatcagaatccccttcagttcggcaaaatcgtctttctttacagcaaaggagatggcggattccgttgacgcagcaagtgtgaagggtcttcgttccggcagagtgttagtcacagacgatacgccaaacatgcacttttcccttatctccgcccggagtgcgccaagcctctcctgcacctgactgatatctgtaatggcatttccatagcagatggttatcgaaatacggggaggaagcagcgatagaattgattccgcgattccggccatatcaggctcgtttaacccctccagaagaagaatctgttcattcatcgcctttccgaaaaagcagaatatccctttctcctgtctggtcacaagggaaacgatctgttttaagtcatgattcttccagtacacattccccggtgtcatctcctccagactgttggaattaaacgcgccggccatcagatagacgggatataccgtctcaaataacgcgttccccgcctcacagggggtcccttcatacagtatccctgtcagaatcctgcttttttccgcccccgccctctgcctcagttcttccttcatctgagccagcagcgaagccagttcttctctgtccacgggcttcagcagataattttttgcattgtataagagggccttccgtgcataggaaaaatcgcggtaaccgcttatcactaccgccagcgtggaggggcacgtttcatatatgtattttagaatctctgtcccatccgccattggcatattaatatcggtaaaaaccacctccacctgctgctcttccagatattccatggcctctctgccgtttttcgcgcatttcactaccgaaaattcaggatcaagtccttcgatcatcttttttatgccgcgaagcagaggtaattcatcttccgcaatcaggaccctaatcattccaattcacctccaagcagcacaactgccccctcctcatcgttatataaccggcattcgaaattcctgtcatagcatatcatcagcctcatatagatattggggatgcaaagcccgccgatcgatatctgttccaggctctccctcacatttttgaaggttaaattctctttcatccttccaaattcttctaagtactcttccgcaaatcccgttccgttgtcatgaacttttataaaccatttcccatcctctgtataaaccagaagcctgattttccataccggttccgtgtttttaaaggaatgcttaaaacagttttcacagacaggctggatcataagctttggtatccggacgtcggacagcgcctggtccatatgaacctcatattcgaacaggtcttcgtaccgttccttcatcagttccatataattgaccgcattttcaacttcccgttccatcgtacagaatccatcttccatcgatgaggtaaaacgcagcattttgcagagccgcgaacagatattttccaccttcttattgccgtctgcctgtgattccatggagataatcgccaatatattatagagaaaatggggattcatctgagactgcaatgcaaataaatgggatttcagttcattcgtctccgcggcgtactgctgttccacagactccttcatccggctcaataccgcgttaaaagcattcttgatctgtaccagttcatcgttgctttcataacctgcaacgtccatccggagatgttccagtgagatcgttttgatcgaacggttcaactccgtcaacggctttgacagcttcctcacaatcagaatttccgtcacaatcgcagtaataagaatcagcagcattcccagaatcatcagtcggttaaactgggccagcggctccatcagcacattctccggtttttcgaagagaatggtaaacggcgcgttccgcagttttctgctgcacacataccggcctggtacacttttatccccgtcggtcagccgcccctctgacgccatctgtatcattgcttccagtctgctctcggtcctgccgctttcggagccgaagctccggtaaacagcctccccctcgtccgttaggattacggaattaatatctttccctatcccataaaacatttcatccagccgttctgcaaattcctgcacttccacatatccacactttaagctgttggaagagtaatccttaatctgtctgacaacagaaaaatacattttttcagataacccggtatcgttcagcacatcgttttgcggcggaacgaagcaaacgaagctgtcctcctgcctgaagaaatcgcgtatctttgcatactcctctcccgaaaagtaagcctctgttccggtcgctgtcgtaacggttgtcgccgtacagacaaaatcctgatcatcattatagagacagattctggcatacccgtccttcttaaaattataagagttcagcagcttgataacctccgaagcaatgagaggctcccggataaaaaaattgctgtccggctcctggtccaccttctggaagacactcacgatattgggatttgcggctatctgaagcgccgttttatccatattataaaggtggttatccagtctgtcggcaacgctggtggcgatcacctcaaaatcatcatttgtccgttccgttatggcatccaccacataccggtaaaagattcccatgagggcggccgatacaaagagaactattactatgtgaaaaaaaatcattttcgattggaactttacttttttcagcataaaaacctttcttttcggttctttctaccccttcactgctccggctgtcatcccctctattatatatttctgcagggccagatacaggatgacgatgggcagcactgtaataacaagcgcggcaaagacgtaattccagtttctggaatacaggccataaaaattgaagatcatcatcggaatcgtcgttcgtttcgaactgctcatcagatacaggggcacctggaaattgttccagattccgatggctgcaataatcaggttcgtgatcatgaccggcttcaggatcggcagcagcaccttaaatatcaattgaaatgtattgcagccatctatgatcgccgcttcgtcgatctccttaggcacaccagtcacaaagctggaaaaggtcatgactgcaaatggcagattcaccgcagcgaagacgagaatcacgccgatataacttccatacagattcattttaatcatcataaaataggttgtcaccatctgcatggtggctgtcagcccaaatacaaaatagtaatacagggcgccggcttttttatcgttccgtctggaaattataattcccgtcatgcagccaagtataattacaatggcgacagaacacaccgtaacaatcaggctgtttttatagccccttaaaatctcccccgtctgaatcacatgcagataattttcaaactgaaaatgtgacggcaggctcaaatccatatgcagtgcctctccctgagtcttaaacgatcccaaaatcatcataatcagagggatcagaaacaccggacatagaacaagacagatcaggaaaggtattattttttttctatggcgtatccagaatatcttcattatacatcaatctcccttgattttaatagtctgtttaataaaaatgtgattatcacaattccgacagacaacagcaacgcgctggcgctggattttccgagaagtcccattccgaacgcacggtacgtataagtgcttaaaacctgagtgtcgaaccctggtcctccgccggtaagggagtatacgagatcaaatacctttaaaccaccggtgatattcagcgttgttacaacggtaaaagatggggccagcaggggaagcgtaatgtggcaaaactgctgccacggactggctccgtccaactgggcgctttcataatactcaccggagattgcatttaagcctgagataaaaagaaacatgctgaatcccgcccacatccagacttcaatgaagataatccagaacatcgcggttccatagctgcccagccagtctctggccaactgccccatccccgcggcagccaacaggttattgaccagaccatcctgctttaaaatcccggtaaataaaaggcccacaatcatgcagctcagcacacagggcagatagaacagggtccggaatatgctgttgccgcgaaaatgctttacaaccacaagcgcaatcagcagccccgttacggttttaaacagcgtggtcgtaaacgcaaacagcagtgtgttaaatatggaacgggcaaatacttcatcctggaacagattgataaagttgcgaagacctataaactgcggtgaatccatacggtccaaattccagttcgtaaaggaatagaagaatgcaataataatcggcactacaaaaaaaacggtaaatacaagcgcccccggaagagcgatccacattggatatatttttgaacgcagctttctgttcatacattaaaacctcctgattaatgaaagaaagggcgctgctctgccttcacagcccgcagcacccgatccttaaactacttatttaaaatccttccgctccctgatccttcatatactgctcataatccttctggaatttctccataacggcctttccatccatagttcctttggccggagcatccacatagtaaacgtataagctgctctcaaacaacggatttaatgtcattacgtaataattgaattctgggatcgcttttccctctttgatatagttttcattaatctcagccaggtaatccggaaccttgccgccgtcaacaccctggaatgccgggaatgccgggcggtctgcaaagtagagatttgcatattccggtgtggaccacagatcaaagatctttttcacgacatcgagattctcggaatttttatatgccacgaatcctgcggaagacatattctcggtgataacgtccgcgccctccttcatagagatagggaacataccgatttgggcttctggatttgcctccaggacagacgtcgcaaagaagtctccgttaaagtgcatggctgctgttccgtccgccacagccgcgatggcatcatcgtaggttgcggatgcaaagttgctgtttacgtagcctttctgatataattccagatatttgtccagtacctcggcgaattccggaacatcgctccactttgtttcgtttttcaggatcttgtcagcaaaatccttacatccgtccgctcccaggatttttgcaaaattgtctgtcatgagtatctgcggaacccaggtatctttcggcataaagattggtgtagtcccgctctcctttattttctcacaggcagcgagaagctcatcccaggttgccggcacctcaacaccagctttgtcaaacacatctttattgtagataaatccatgcagtcccggtacggaaaggaacgggaatccataaatctttccatccttggccgttacgttccccggtataatcagacggtctgtccaggcttcgcccgtcatgtctgcaaaattagatgccggatcaatgatatcgtacacggccgggacattataatcaatgatatccgggcactctcctgaattgagcttcatcttaatcatgttcagagattcatcatccggcacgatctgtgcatcgatcttaatattctcttcctcttccagtttctgaatcattttctggagaccctcgaagtttcgggactgctgaatcagggctgtcacgaccaccttttctttgctgccggcttcctttgccggtgtctcctgctgttccttcgaagcctcagcctttactgattctgtctgcggaacctctgctgctgtgtccttcccctggccgccgcatcctgctaaagctcccaccgtcaccatacacgctgctgcaattgcaaatacactttttttcatgtaacttcctcctgtctctttgatagatttatgataccattcctaatcctctgccgtaaatgtacaaaagttaaatgcggtatggaaaaaaattacatgtttatcttcggacaaacgtgctgccgggactaagaacaagaaacagcggccttgaaattagtcactttcaagaccgctgccgattcaacaggacaacacgaaattccatctattctattttgccagtaatcgtaatatctccgctctcaaaaaatccggtacaattataagcccatctgccggctgaaagcgcgatcgtttttgtcacatcactgtcagtgatcgtaatacgatgttcttcatgattgggtgaaaaaagagtgatatctgcggagccgcccttaatatcagactgaatggtaagagttaaaacctgatcgtctttcgcatcaaagctgcccgagcgtgtaatactgtctcgctttccattactcagatttatgacagtacctttattgttctccacttccgctgccgttttgtcgggactatcaccattgccatgactgcggggaaccgtgccgcgaatggtaatactgccactcttaaagaatccggtacaattataagcccatctgccggctgaaagcgtaattgttttcgtctcatcagaatcgttaatggtaatgcgctgttctttgttatcaggtgagaagagaaacaaatctacagaaccgcctttgatgtcagattgaatcgttatggttaaaatctgatcgtcttctgcctcgaagctgtccgatttggtaatgccgctgtgtccattactcgacagatgaaagacgacctcctcttctgtctctgcggtatcctgtccagaggcatttcccggcagcggattcggggcagcggcgtaagcgccggtaaatgctcctccaaggcagatcgtaagtgtcataataaaggataatactttaatcatctttgattgttttttataattcataatagcatccagcctttctttcagcagctctctgctttcattcaatgtaacagaggcaagtgaatttttgtagtttcctttgggtctgaccgcacccagcaaggtattcccatagtcccgcatagcgttctcattcaaatgccggataatagcttcatcgcaggatagttcacacagacggttgacatcgcgcgccatcaggtacacgagggggttaaaccaatgcagacataccgccgtctgcataagccatttataaaacatatctttccgcttaaaatgcgtcagctcgtgccttatggtatattgaaaatctaaatccgaacaatccgttcccggcagcacgatacagggatggaaaaaaccaagcagcagaggagatgatatgaggctgtttgtatacagttccaccgggacattgattttcgcgtcttctgcctcttttccaaactgctccataagattaatatcgtctaccggagtacatccggcttttacgtattttataaagctctgatagattgtaattttccgtattaacaggatcagagcgactaccagccaaaccaggcccaaattacgtatcagcatcagaagaccatatttcatcacatttaccggagaatagtcttcgtcctcggctttactgtcatctgtgatagtatttggaaagagatcagttccctgcagcgacgcaaaaccagattcaggaagcattttccgttctaattgtgaggctgcgtaatcatagtttctaaagaggctacccacaagattatgttccggcgcaaaggggagcagcagtctggcaattacggcgagccaaatataatactgccaggccttgctcatttttgattgaaataaaggtttgcaaaggaacagaatgagaataaggatagacccggaaagggatagtgacaaaattagttttatcatttcgtttattagtgactgcctcctttttcccaatggcgttttaagtcctcataatcctcgcaggaaagcaagtctttttgtaacagcgtggctacaagccccttcgcatcgcattcatagactttttcgagaaaatcctgcgtctgcacctcctgatactctgcctcggaaacaacagctgtgtattcattcctgcgtcctatcttattcgtcttcaaaaagcctttgctggccaacctcgaacataaagtaatgatcgtattttttgtccagggggtacctctgtcctctaacgccctgacaatctccgcatacaacgccgttccaccgttgttccaaatgattttcataagtatcaattcatattctgatatttgctgcatcttttctcatctccattttagattacatgctgtactctaaatttatgataacattttgtactctatgtgtcaagggatatcatgaaatgattggggagacagaaaggtgctgagaaatcccgatgatatagagatttttcagcaccttttgcgttgtattttttatgataaccttttccagacatgtttagaaaacactatattcaactgatattcgctaaaaactgccgcaccgcctgctcaacatttttacatggccttccctgtgtctttatgccgttttctccgatacaaaccacatgaaacaaatagttattaaccggaacatagtccatttctatcatgatattggcatccagatcctgcagcaataccatggttgtctgtgtgctgttaatacagttctgtacttctgacaggtattccagacagtccgcctcctcatggaaagcatctgtcagcctgttcaacttttcgattctgtcctttgccgtacatttggtataattccacatagcccctccttcttgtattctttgctctgcctcagtgtgtcaactggtactgcattgcgtaatagcctttcagaaaatagatatgctgattcctgtatattactattttacacaattatggaggtgtttacaataagttttgccatcagaacctcccctcctccacccgcatactgtattataaaacaacgttgtcccgaactgcgaacagcagccggcaaaaggatgctatgatgaatacagatctatgcagcagaattattctgccgtactgtccgtcctacgaatcggcgaggcagatctttaaccgttccatacaaaaatgtccctcctccatcatctattgcaggaatgatgatgatgcggcacaggcagtttgttatggcgccaggcagaagcaggaaatccgagtgagatccggcggacataattatgaaggatactgcatcggtaatggtaagatgacggttgataccagtcctttaaaagggattcagcttgacagcaccggaacgctcaaaatcggcggcggtgtctccaacagagaactttaccatttcttgaaacaatacggctatccatttcccagcggtacttgccctaccgtaaatgcagtcggcctgactcagggaggcggctggggacattcctccagaatgtatggactggcctgtgacagccttgtggaagcagaactcatcgattcctccggcaggctgattactgccagtgaagcgtctcatcccgaccttttctgggctctgcggggcgggggaggcgggaacttcggcgtcgtgacatcactgagttaccgccttacacctgtagtctctcatgtcacctatgtggacatagaatattcccggatcgacgatttaaccgcgctccgattctttcagacatggcaggcatggaccacaggcggcgagattcgtttcacccccaacagccgcatttttaattctgcacgggacgggatgggcatattcctgcgtggcttcttctatggaacaccggacgaagcggaggctgcggttcagccatttctcgatatccagggtgcacaggtttcgtttcgctatgttactttttgggaagccaccgaaattgacgcttcgatttacccggcttctgaaacgtttcggtttgcaggacgcttcgcgtatgcggacttttcagacagccagattatatcgctcctcagcctcatcaagaccagagcgcggggggcctcctatgcttccgtggcactctacgccatgggcggcaaagtcagagctgtaaatccctgcgaaaccgcattctactacagaaattccgactttatcatcggaatcgagacggtatgggaagactgcctcttcgaaccggagaatcaggcatggatggcggcacgctttccatatttacgttccttaaccacaggttcgtatattaatttcccatatctatgtacagatcactacatggacgcttactatggagagaataaagaacggttaattgaaatcaagaaacggtatgatccgtgcaatctcttccgcttccctcaaagcatccgggctgaccatccgccggggcggctgccggaataagcggccgccaatgaagtttcaaagcagttgcggccggtattgtcacttcagccagctcctcaggaatggtcctgccaatgcaatgacagggaagccaactccgataaaccggaagatccatacgaaaaaccaggtccctctctgttcttttggcacataaatcttatccggacgcccgggaatatagtgaagctctacctcctctccaacggagacggaaagaaagccgctcccaaagctgctgttggtgctggattccgaagtaattctgtgcttagcgccctctgcgtaaaactcatatatgggggcatacgttctgtcctggctgctgccccgcggttctttgcctaccacgacggcagtggtcacggcggtggcgaatctgcgtctcttaacagccttacgccccatagctgatccgatcaccataaatacaacaggtaccaggacaaaaaggatatctccccattcccggtctgccataccgcggtcatactgaaccatgatcatccccccgatggcgcagtaaaacaaactccacagaagtaaatatccccatttcttcccggtactcttttcttcctgcggcatccctgtatgatcttcccggctcttgacaagtctgtagaaatgaactacaacaagggctgagcctatcagtgaaatggctgatactacgataacaaagatccaaagtgatttattcatggcggtatcctcctgtcggcagcggtctgccagcaaacatttatgccgcaatcgggtgcatgctgcttcataaattaattctagtatatgcctgccggtatgtcaaaccattcctccagacgcctatggtaatgattgaatcactgcaacgcctgcaagctggtgtagcttcttaaacttcagtttcgtgcgctccgggaaggtttaaaatcatatatcattggtgcctgtcaaaaataacaacttgataaaaccctaaaacggaatatcagcatttgacagaattgttttgagaacgtagaatgaaataaaatacaaaataatttaataaaaaggaaaaacacgatactattggcaaatatacagggaggtgtctctatgaacgataagattaaaactgctttgagctctgagaaatcaatgactgttataaatctgctttttcttttgtcgctgttcattcgtaaccgcggaatcatttttattgcatatatcgcatggatcgtttttctgatctgttttattaagaaaacctcttccagggccgttagggctgtcaacggaatatttcttatctttgcggctgcgatgattgtgataaatctgtattccatgattagttatagataggaaactggaacttaggatgttggtttttaaacgtcgtttgggaatgataggctgatgggaatatggataatacaatagaatcaaggtccgcctgatgctatcgcattatccatatattgcttatccgattatcccgtcttccgcctctgtcttcttcacgaaatccaaattataacgcaccgcgccgtggtctctcatgattctggcacgagtaatgcggatcgccagaataacacagctctcgtctttttcgtcgtttgcctgatcgtaccagtcggcaaatgcccggcgaagtttcactctcagttccgcattcttcgaatccagcacccagccaagattttcaccaatcccatgtccgtaaatcccctcgaagcaaacagcaaatgcggtctctttattctgagcgatctgaagcattttatttgacttcgcccatgtcgtaatatagaacactccatcttcataataagcatccacatcacgaacacaggaactgggcattccatcagcatttggttccattactacggtcgaaagcgcaataacattatcttttccattgccgcagctctcttctattaattttattccctcttcatatctgctcattgtttaactcctcctgttaaatttatcgttcgtgaaactcacaaaaccggcaactcatcatctttattaaaatcattcacagctttagccatgattcattcactgccattccgcgctctgaacggaatccacatctccatatatgccatttcaggcgtatgatgatcatacatctccgggaagaagccgtcagcaatcaacccgtggcttttcagccagcccctggtaaatttcatcatctttcccatagaggccatcagctgtttgggattatcagcctcaaatgaacagatgacatattctctcgcaggcagctgccagcttacaaaacgggaatcctcttcacacggttctaccccgatgaaataagtcgaatacccatccagcgcatcgccgtgataagagacaccgagtatccgaccgccgggtatatgcggaatgtctttcagggcatcaaaaaactttttccaaatggcgtcggattcatctactcctgtcctttcacccatcatcttcccttttgtaaaggagtaatatccgacaacaccaaggaagttgacaggctcccttagggttcttcggttatattccaacactaacccttcgccgattaaaggcaccccttcgtctaccatcctgtaattcagggatagatcaggcttgtcataattcattaggcctacgggcttgtcccggtattgcgccggtgtgatgccataggtgtccttgaatgcccgtgtgaaagtctcacgaccgccgaagccgtattccaccgcaacgtttaggatgctgttttctttgtttctcagagactcgcatgcccgggccaaacgccgcagtttgacgtattcccgcaccggcttcttcaccagccgcgcgaacagcctctgatagtaaaacagtgacagtccggcaagatccgccaactcctcgatctggatttcctcgccaatatgttcctcaatatagtttaaagtcttttgtatggattcccacgcatgcatagcagcacctcgcttctcactataccataattttcagacagatgcgtgaccgtgtctgccctttttctattcggtgttccttccggcatactccattcttgaggacatctggatataacgctgtttttaccatcataccacaccgaacgtatgtttgcaatcagaatatgcatctgattctatatcaaccgcctccccctctgcataccctatatagaattggaggcgtaaataatgatgagacaagaacagctaagcatcgtaacagacaaatacttaacatgctttaacaacatactggaccagatgatacagcagatgaacagtgcccaactgagcaacagtatttcctataattttattgttcagatgattccccaccacaaggcagcaatcgagatgtcctgtaatctcctgcagtacaccaccctggtaccactgcaggaaattgcgttaaatatcattgaagaacagactaagagcattgagaatatggaggcaatccggaaccgctgtcagatgttctgcaacccgccgcagaaaatcgaacttttcctttgtcactataagcagattacacagactatgttcgatgatatgagaaatgcatgttacacaaatgatatcaatgcgaattttattcgtgaaatgatcccccatcacagaggcgccatccaaatgtcacgtaatgccctgcagtttccaatctgccaggagctgaagccgattatccagtcgattatcgtgtcgcagcagaatgggattcgggaaatggagtgtctgcttaaatgtattgagaaatgtgacagaccgtgctaatgggaacagcaaatgcagcaataccccggttgccatcaatagaaccggggtatatcgactgcatttctgcttttattttcaggaaagcaggcccaaaatggtatgataccaatcagggattttagcacttacagaatactgtaaatcctcccggcttcacttaatccacaggtattaaatgctgttattacaaagaaatacgtgttacctgtgttcagattgcataacgttatttcattggttttaaaaactctgcaggtaatattcagactgtcggcatgaattccataaaatatctcgtagccatccgcaccttcaaccgggtcccagcgcagatgtaccttcctcctgtcagctatatctctggtgacttctgcatcagtcacctccgccggttttctgcccgaagctgtcccgaatacccgcaggccgctgaccgcaaattttcctccggcaggtacatttcccatgttggtaagacgcaggtaccgtattgcagttccttcacagacctcgtaataatcatgtgaggtatcggttgcaaaattaccacagcgctcatgtttgctgcagtctgccagcactttaaaacagcttccgttcatggagtactccaggagataactgtagttgatactgccttccctccgcccggtattttcagcctgttcgtcggcaaaattcactgcaatcccattcactgtacacacgctttccaagtcaagtatcaaatattcccctctgctgccactctcagcactccaccagcttcttatattttcatctactgcatttgaactttcatggcctggaatgaaagaagagcattccgtcctgcagccaaaggaaagcagattccatccagggcccgggctttcaaaaggcagttcactctcattcggcagaaacataggataatccgcacagctcatattacattccagttcgccgtaagcattaaagcgggcaggcgtcatcacaattcgcctttcaaaccgatggtttacactaatgctggctgtaccgaacttccaccagttcccctttaaatcccgaatcagggagccatgaccggctccggtaacatagcccgtcgccttacaggaaaccggactgttttcacaataagcaaagggacccatgggagaatccgccacataacagccatccgcataggttctgtactcagtccccggcaccgcatactgcaaatagtattttccctcattctttactgcccaggcgccttccagccagcattcaccctcgtacatcgtgttgctgtcaccgggaacttcaaagccgtgctcttccggattggaataaatacacggtttcggtgcccctgtcaatgccatattattttccccgtccaattctgccacatacaatggaagcttatcgctgcagccataataacagtaaatgcgttgatcatcatccacaaataccatcggatctgccagatccagcggtctccccacatactcccagcgtcctgactttggatctgacgatttgaatatagaaccattttcagaatgtacgagataaagcgtatcccggtattcatacgcggtcggcgcaaatttctctatttccggcataatctccgggtctattgagacaaagttccattcgtataagtctgttgaaaaccagtacccttcacaatgagaagcaaacaaatagtattccccacgaaacaggatcacagaagggtctgccgcctctcttccataatatccctcctgatatctgtagctgatattgatgggattgcagaacgtatgctgtttttcatttatcctggcagccatttaatgctctcctgcggtccagtgaatcgcctgatgcatgattcgccggaaattttcattcccatagacattgttatcgtggcctgaggcgtaacagaacactctgctgtttttgtaccgccttgtccaggcaatcttatgcatgccggaggggttatccgtctcaattaaaattgtatttcccagctcttccggttctccgatttcataggtttcatcaatcagagtaaacttatcaataccgttcataaccgggtggcccttatccacaatatattggtctaccctctcattctggtgaaactgaaactgctcctcacagcgcactttcactcctgaaacttcagtataaatatcccatctggggaatgacaaaagcgcatgatgcatcaggataatcccctgtttcgtatttcccaattcctgcaccatgtatcgatacctgtcgcttccctcttccggtaatgggagactcatactgtagtaaagaaccgtatcgtagctgtctctgttttccgcgtcctgaataaataagtcaaacggttgtacataacagtcacagtcttcaaaggaccacagcattttttgaaaattcacaatatcatacggatgacactccaccaataccgctaccttaaaccttctgtccatattagatctcctcctgattatggaagactacgggagcatatttcctgccgcacggtatatctcataccactccggcctgttcatactgacctccgccgcttttgcgatttcttccagtctgacaatatttgtcgttcccacaaccgcctgcatatttgcaggatgtcttaagatccatgcaatggcggccgcactcattgaaatttcccgcttatccgcaaattcctttagtgctttatttaactcaggatatttttcattttccaggaatgtaccctcaaaaaatccatactgaagggaggaccacgtctgaattgttatacgattcattcgacagtattccaatatactgccatccctgtcaatacctgtatcattgtgcatattgacattgattccctgatcaacaattcctgtatgggcggcactgaactgaagctgatttgcaaccagtctctgatgcagaatactctgaagatacgcaatctgcatggaattcatattgctcacgccaaaactgcgaacttttcctgactcatacagatgatcaaaggcctcagcgatctcctcaggttccattaacgtatccggtctgtgcagcaggagaacatccagataatccgtatgaagtctcttcaaaatgccttctgcagactcgatgatgtgatcttttgatagatcataatatccggaccggataccacattttgactgtaaaataatgtcttccctttttatgctgctgcgcgtaagagcatcggcaaatatctcttcagatgcaccgccgccgtaaatatctgcatgatcaaaggtatcaataccaagctccgcagacttttcaatcaacgtgcagacttcctgcggacttttttctgcaattctcatgcagcccataataattgcggaggcagcattgctgccgcctcccatatttacttttttcatactgtttctgctccatctgtttatttgtatacttcgtctctgatctcctggacaaatttcagtgtcttttccgtctcatatgcatagtcgatttcagacgcaccatttgtaataacccagggacaggctacggatacacccttatcataccccgcttccttcaaaacttcaaacagatgtttcagaatatctctccggtctcctacgttgggctgcgcaccgccgtctccctgaatatgtacatttaagcagtactccggatatttaagaatatcttccagcggctgtcccagttccagaaaatagtttaaatctgccataactttaacattgctgcggccggtcatttttgcaaatgcaaccccttctaaatatcttggaaacagagtatccggttctgcctgcggctcaagtgcaatctgcatatcgtattttgctgcaaaatccgcagccatattaatggtactcagagcctgatcaattgccgttgttctgtcaaaaccttcctgacatctgaagtggccgccccagcatccgatatacttaacgcccagctgactcatacgcttaaactcccgctccagagagaaggcaatcagctcccggtcatagtattttccgcttccgccctgccataacatgcctggccctaataaatggctggttgtcatacacggtctgccgtctgcaatatactggtctctccagacctcccaatccgcgtcacagagaatcggatctccatgtattgatgccgggacctcaaagtactcatatcccccaggtacatccttaagcggcacaacatcaacgacaataccaaatttaaacctctcactcatttttttatcctccttatggtttttgaactgcacaccagtggcgcaacagttattaacaattttatttgtatctgttggtgaggctccttgtccggcaaagtgtaacaagaagatctcccctgactgaatcgttacttttatttttcaaatctcaccggattctctgccataaagtctgcaaattcctgtgcgatctcagctgttttgggctgataatcggtgtcaatgaagtttttcagttcatctaactgtacttcccctgtcacataacgcacctccaggctgttcaacccctgcacgtcatccgggaactcaattgcaatcttatccaccacttttacaaaaggcgtgtagcactctgtcgtcacctggtctgccgcctctgtctccttctgccatttttcaatgatctccggagtcgaacctcccatcagtgcctcctgattctgatatgcattggcaaatgcaaacatattgctggtcactttattaacggcttttgtctgttcctctgttctgtcaatcgtcctcgtttcaatatcatagctgttatagtgtattccctgcagtcccagctgcatggcgacaaatccttcttccgagttcgcccagtccagtacttttaacactgcgtcaatatgctcggaatctgcgttaataaagtatgccatccagttggagggaggcatcacgtagaccggatcatgagactcatccagtgcaagtggtgcacagtactcataatcatcaatgttcaggccgtatctctccaataccgtggttgtataattttttccagatgttccgacaattccaactcttccctgtgcaaacgcttccgtatgttcctccgatttatgcgtaataaattctctgtctacaatgccttctgcatacatatctctcagcagtgtaacgtaatcgtaatactcagatttcagcggtctcaatttaaaactgccatccgcatccggcattccatgatgccacgctgcaatgttgtaggcggtcgacaggaaatcattattcatatgccagataccggaatccatactgttctgctgcgctccgaagctgactccatacgtatcagctttgccgtttccatcgggatcctgtgtcgtaaatgcgcggcagacttctacaaactcttctacagtcctgggggcgtccattcccaccgcttcaagccactttttgttaatcaggaaacctgctttgtcataagagttcggtctgggaaccccaaagattctgtcatctccaagcagcttcgtgtctccatactgctcttttgagatattagttgaaagattcgggtaatcttttatcaaatccgtcacatccgccagcagcccttcctccgcccactgcgttgcatacgtgtctgcgccataggcaaagaaatcaggcatatcgccggttcccacaaggattttcacacgatcccaaaagttattgagcggcggcgcttctataatcagcctgacgccggtatcctcttcaattttctgaagaatcggattattttccagcgaaatttccggattaagctgcaataccgcagttacctccacaacctccctgccatcattagcagcttccgcagtcgttttgttctcccccgcttccgatgtttgtgttgctgcatttgacccgcatccagcaagcatggaggcgaccaatgcgctgcacagtaaaatactttctacttttctttttaacatccctttcttcctccttcttccttatatctgctccgcacctcttatgcggctgcatacttattcttttacagaacccagcgatacaccttttacaaaatatttctgcataaaaggatagacaatcaggatcggcagtactgtgatgatgatcgccgccatctttaaggtaaacggatgtgaacggttcgccgaagtaagcatctgggtcaccgatgatactgccgaggtgtcctccactaccagttctcttaataccagcgtcagcggccataaatcccgatcagacacatacagcattgccgagaagtagttgttccagtaattgacggcacaaaacacaatcatagttgcaatagccggttttaacagcggcgttacaatccggaacagaacctgcagatcattggctccatcgattcttgccgcctcttccagtgcatccggaattgactgtaaaataaagtttttcatcagaatcaggttgaacgcactgatacagcccggaataatcagtgaccaaacggtattttgaagcttgatccctctgatcagaatatagttggaaatcatgccgccgttaaaaaacatcgtaaataataccattcccatgaaaaacctgtgtccttttaaatctttcttagacaatggatacgcggaaataaccagcagaaatatactaagggccgttcctgctattgtgataaaaaccgtgaccaggtatccggaacgaatcaaatcatatcccagcatttgcttataggccgtcaaatctatatgggacggtataattttcaaaggattttcaatatattccgagtatggcataaaggatacgcaaaacacataaacgaacggcataacacaaattaaagcaaaaattcctaccacgatcatgctgacgtagtccattgctgtcagtctcttcttcattctttacacgcctcccttctaaaagatcccttcttctcccattgcttttgcaatcctgttggcaaatgtgagaagtgtaaaccctattacggaattgaacaggctgactgatgaagcaaaggaatatcttccgtttacaacacccatcttataagtataagtctcaaacacctccgataccgccagattgcttccgttttgaagaacatagatctgttcaaatccattattcataattccgccgattgccagtaaaagcaggataataatagtaggtctgatacacggtaatgtgacatgccagattcttgcaattcttccggccccatctattttagccgcctcgtataaatcgggattcacacctatgatggcagccagatagataatggtatcccaaccggcctgtttccagatatgggatacaattgcaatgcctctgaaatacttatcattgcctaaaaagaaaatcggctctccaccaaactttttaataacatcgttgacgatcccccaggaaggagacagaagatttaccaggatgcctccgattaccacccaggaaataaagtaaggcaggtaaatcatggtctgcgccgtctttttatatcttgtaaaaggtatttcattcaacagaactgcaagtaaaatcgggattggaaaactgatcagcagtttttcaatgctcagtataagggaattagcaaataccctgtaaaactcactgaggccaaataaatacttaaaattatccaggccgcaccatggacttcccatgattcccttggaaaatttaaaatctttaaaggaaataatcaatccatacatcggtacataattaaatattataaaatatacgatacatggcatcagcagcaagtataaatatttatgcttctttatatacttccacatgttcttgtttctcctttcccgtcccttgatgatgtcagtatatcagatctcttttattgtataaataaactaattaatttggtttatcatcacttttttagtcattttgcatcgccattcaatgtttgttattatttaaaatagatttatgcacaaaacaattaagtttttgcatcccgttattagaatgttgatatttaaaattgttttgtgaaataatcataaaaaaagtgcggcacccgcaatatgttgtccgcactttttctgttaccttttctgttttactactattttggtaaatttatctatctcactttctattgtcacctctccttctcctcctgtacagatatcgattctgtccatcacattcttaagtccatagctgccattctttcctccgacacttccatccttcaccaggctgatccgctcctgggtcataccatttccgtcatcttccaccaccagatcgtaataagtatcatcataaagagagtagatggtaacatttaagacactcccatcttcttttcttccatggaggatggcattttccagaagcggctgcaaaaccagttttactgtaacacagttcagtaattcatcgtcaatatccacaacaacattcagctcatctccacacttaagcttctgcagataaacataggcctctaactgctgcaattcccgctttagttccacctgattctcctgcatggaaatagaatatcttaaaaaaactgctaatttttcaattgcctccggtaggattctcgttccttcctcactcctggtcagccattttaatgtagccagggcattgaaaaggaaatgagagtttatctgagcccgcagggccaccatctcggcggtacgtttgctcttatttcgattttcaatttccgccagcagctgattgatatggagctttgttctgtcgatctcactttccagtactttaaactcatttagtccttcgatctgtgcctttccattttcctcgtattcgtcatgtcctatcgccataatttttttctggatgatccccagcctcttattaagctgattggaaatgaaggatacaatgaaaaaagttgccacgattataaggaaaataattggaagcatccttccgaatacctcccacagcccacgttttaagtaattcaaatccgtattaacaaccactttccagccattatcagtttctgcaagaatcggaatctttccattgctgtctttcaggataaatgcaccttccggatttactttccggcgctgcagttcttttgagaaataacttctgtctgacatggacatcacggcatcaccgttataaatcacaatatcgttaccgcttttatcttcattaaaaaatcgatacaactccgtttcatagatccgaaactcgatataaaaccatcgttttggatttggctgataaatcctcttataaaaggagaacactttttcatttctgtcatttaaataagttccttcataagcatattctgattttccaagctgttcctttacacaggctttatgattttttcggaaattctcatgtttttcatcataaaagccctgcttatacaaattaatttcactgattcttcccgaattcagcgtcataaattcagccgtcattttctttaaatactcactggcctcttcataagtatctgccttcagcagatttaaaaaatgactgtccttttgaagcaggttcatataggcttcataatacgcaaggcagctgtccgtatttatggcaacctgtttcgcctgtgttgttagaatttcttcctcctgttctctgtagctgctgccaaggtaaatatacaaaataattcccagactcaaaataatgataccgatgaccagtgtaaaagatgcaaataattgcgtcctgaatttacaatttctccattttttcatctgtattctcaccctttatacttctgcctgtattcggttggagttatccctttttctttcttgaaactggaatgaaaataactgatattgtcaaaaccgcattgcagcgcaatatcactggccggtaagtcgctttcctttagcagcctttgggcattttccagtctgactcccattaaatatcggttgattccgcaccctttcgctgttttaaacacggttcctatataatttggtgtaaaatgcattgcctttgcaatagactcaatcgtaattggagacgtatactgtgtttgtatgatattttcaatttctgatacaatctgagccttcccttttttccgctccgctcccacttctacctgagcacttgcatatataagacttctctgacgaatttcgtcatacagctgccctgcgtcttttgtattcccctcttcatcacacacggattcccgacgcagaattttgcagttcttttctccaaaaaattcatccactaatttttccagtttgcctgccgcgtctgtcattccttccggacttatgcagaataccgtaacaaggtttcctctggtcagacatatatttacaacctttgagcattggctgcggcatgtttttgtaagtgaatccagcccccttgttatgcagtctgtcttttcttcatcaaatgccgttacaatttctcccaacgattcgccatctctggacaacatccagcctaaattcagttgttttgcttcctcactgtctaccgccacattcatcagcactctgctgaccagcgcctgccgggcaagctttaaactgacctcataattatttttaatcttgttatacagtcttttttccaattccttctccgtaatctggtctactgccttttttacatttctcaaaagcagcatctcatttacaggcttagtcatataggaaaaaatatttaactcgatcccctgtctggcatattcaaaatcatcgtaggagcttataaataaaatcttagtttccggaaggattttccggattcgctcggtcatctcaatcgcattcatcacaggcatactgacatcggtcaggataatgtccggcttcagttccatagccagatttaacccctgcgcaccgtttgcagcctccccgatcacctttaccccaatcaactcccagtcaatgctattctttaacgcatttcgttcaaaactctcatcttctacaatcattaatgttgccatagaaaccccttccctttttattaacacccccatgttgtttttatcttaccataatttatttgattttcataccctctccacacaccaatcccccggtccgaacacccggaccgggggattgtcatccacttcttccttatacccttttcttcttccgcgccataatcatactctgcaccaccaaaaacaggcacagcatggcggccacagtaattcccgtccaccacgcctgatcgaggccgatggaggaaacgatattttgaatcgtgctgagtgacagcacaccgacaaacgttccggcgatattgccgacgccgcccgtcagaagcgttccgccgatgatggatgacgcgattgcgttcatctccatgcccatggcatgggaggccgatcctgaacctacgtgcaggaaatagacgtaaccgccgatccccgccagaaggccgcatagcaaatgcgccagaaatctggtcttcttcacattgattccaagcatcagagcgctctgcctgctgccgcccaccgcgtaaaaattccgtcccgccttcgtccatttcaggatacagaacaggataatcaccaccagaacggcgacgatcacgccgatctccacataggcgttaatgtattttcccagcttgtttaccgttccgagtccgggtacattgatccgcgtatctttcaaggctacaaagccgtcattggccacattaaacggagccgtatgtacaatcgtcgtcatgcctctggcaaagaacatccccgccagtgagacgataaacggctggatatccagataggccacgagaaagccctgtaccgcgccgaatgccagaccgattcccagcgcaatcagcagggaggcaaagacactgcctccgtgataatccaggtatacggcgcagctcatgctgaccagtgcgacgacgcctcctacggagatatcgattccgccggtgatcataacgaggctcatgccgcaggaggtaatgatgagcgctgcattcgcattcagaatattaaaaaacgtctgaggctttaaaaacccctttttcagaaatatcatggctccgatatacatgacaaggaaaaccacgatcgtaatgagaagcagcaaattcgtgtcagtcagccttttcggcttatttggcagcgcctggctgcctgctttttttgtgtttgacatatcaggcgacctccctctgttttcttaaactctttccgaggctggaaatcttctcttttacagccggggcgctgatgacgaccagcacgatgacgaccatggccttataggccggaagggcatccgaggagacattaaacttataaagggttgtcgtgaggaactgaatgacataggctcccagaatcgacgccataatattaaacttaccgccgcttaacacatttccgccgagggcgaccgccagtatggcatccatctcgatatccttggcaatgaccgaatagttgatggtggagagccggctcgttttaatcagggccacaaccgctacacacagccccagaatgacgaagctcagccatttgataaacgcagggtttaaaccgttcagcctggaggaactggcgttaattccgacagcctgggtatataagcccagattcgtgaactttaacaccagcatggcgatgatgacgcagaccactgccaggaaaaacggtgtggggatcgggattcccggaataaatccgccgaaatacgtaaatgtcttatccgttacgataggaagctcattgttattgatccacgcggcgatggaacggccggcggtatagagaatcaaagtcgcaaccatgggctggattttaaaaatcgctaccagcacgccgttgaacgcgccaaatatcatggcgaccaggcatgcggccagaaatgccacgatgaccggagcctgaagcgtcccatctccgcccagtccgacgaggactcgcagaatcacggagcctgcgatcgccacagccgcgccgacgctgatatcctgtccgccggaagccgccgtgaccagcgtcatgccgatggccagtatagccacctcggagccatagtcgagaatcgtcatcacatatccggttaaaacagggtctccgccgctgttggtacccagtgtgattttgaaaaacgccgggtcaattaccaggttaaataccgtcagcagcagaagcgctgcaatggggatgaatatctgcttcctgaataaaccggcaaacgcatttgatatcgttgtactcttcttccctgtcattccatctcacctccggcaatggtttccatgattttagcctgattcagcgcctcacccgacagctctccgaccactctgcggtcacgcatgacgatcaaacgggagcacgtgtgaagcatctcatccgtttcagaagaaataaaggtgacgctcattccctctgcggccaattttaaaaccagcttctgtatttcgattttcgtgccaatgtcgatgccgcgggtcggttcgtccagaatcagatattccggatgggtcagcagccagcgggcaagaatgaccttctgctggtttcctccggaaagcgacttaatgggcgtatccgccgacgcggtcttaatttccagcagtttgatgtattcgtctgcaaacttatttgcgtccgctctggagaacggccggaaaaatcctctcagcacctgtgccgcaaggataatattgtctctcacggagaggtctcccacgataccgtcgttcttgcggtcctccggaaggtaggcaatcccatttttcatggcgtccagaggctttgtaatcttaaccgtttttccgttctttttcatcgttccgccgatcaccttgtctgcgctgaacatggcgcggacacattcactccgcccggagcccagaaggccggtaaagccgttgacctcaccctttttgatatagaaatcaaacggcttgattcccgcatcgctctgaagcccctcggcctcaatgacacgctcgtcagcgcctttatagccttctgtcttctcccggatattttccatatcgttcagttccttgccgagcatctttgcaaccagcttcaccctcggaagctcttctatgacgtattctcccaccagctggccgtcgcgcagaaccgtgattttatcgcatacctcgtagacctgatccaggaaatgggtgacaaagatgatgccgacgccccgttctcttaaatccctcatgaggccgaagagcttttccacctccgattcgtccagggaagaggtcggctcatctaaaatcaataccttgcagtccatgtcaaccgcgcgggcgatcgctaccatctgctgaatcgctatggagcagtcggataactgctgggtggcccctgccggtatccccagtttgtcaagaatcgcgtccgcatccgcattcatcttcttccagtccatcatctgcgtttttccgcgtccgatgtacatgttttcagccaccgtaagattcgggcacaaggtaatctcctgatataccgtgctgattcccagattctgtgcgtcacggggagacttgataaccgcggccttctccatgccctttaaataaatttcgccttcatccttttcatatacacccgtcagcaccttgatcagtgtggactttcctgctccgttttcacccatcagcgcgtgaatctccccttcacacagggtaaaatccaccgcctgcagcgcacgtactcccggaaagctcttatgtatatttctcatttccaatacagacttctctttcaccagcgccattcactcctttttgtagggaaagagcgcaaagcgttcatacgaatatcagttatgccgcgctgcactctttccattttctatcctataaacattttattggcttgtcgcctaaattccgtatttttcaacgtcttctgccgtaatggtcgtggcgtcgaagcccttctcatccataatgatagtcttctcggtgagcgtttccccattctgaacctttttgatgatttcatcgatgtaggcagcctggaacgggttgcactgtccgtcgtagttccagttctgatccagcagttccttaagcgcccatttattgcagtcaaatcccataacaattacgtccttgccgacgccgtgggagatatttgccttatccaatgcggctacggcgcctttagccatatcgtcgttttctgcgtaaatgacattgaatttagaaccggaatcgatgacagactgaacgatctgctgtgctttctcggagttccactctgcggtctgctgtgtgatcagattccaggagtcgtcggccgctgcctttgtgtcaagagcgccggtgcgtccctgctgtgccgcagaccccataacaccctgaatgtgaattacgttgtattcgtctaagccctggtcagccagccagtttactgctgtctcgccttccttattcatatcggaaacgatggaagccagatataagtcctcgctggcgtcaatggtacggtcaaacaggattacgccgattcccgcatcctgtgcgtcttttaaaacgctgtcccagcctgaagtgtctgccgcggagagaagtaagtaatccacttcgtcctggataaacttctgagccgccgtaatctgctcgtcattctttaagctgtaggcaaaggaggcgtcatatccgttttccttcgtaaacatggccttcatatctgcgtcgttcgcggttctgtatccggactcgttggggtcgttgttgatgatgccgaccttgatcagttccccatccgctgccgcaggagccggcgcctctgtctccgcctttgccgcttcggttgccgcaggagccgctgcttcagttgccgcaggcgcctcggtcgctgctgtcgttcctgctgatgatgtcttggagctgctgcatccagccaggctggccgccaccatggatactgccaacattgttacgagagttctctttttcattttcttacctccacttttataattgatttcctcctgggattcgtttctccctgtacctgtatcttaccagcggcggcactgtgattcaatttgtaatcccttgtatttatgcggtttggaagttatttacaatacaaatttatggtgatataatcaaaatacaatacaagttgtattctttggtgtgatttcttacaaaacaggtggaaattttaagattctgccatttttcagggatcagatgcggggaatttttgttgtgcatattgactttcaagaagataaaacggggattttttatgatatttatacattttcttacgtttatccggggaacaaatcaggcaattttttcataaaatcgggaaaggtaaggattctatgactgtaaaatacaaatgggttgcagagcgtctggaactcatgatagagaaaaacattcaaaatggaattcataagctgccgtcggagcaggagctctgcacgaaatatcacgtaagccgtcagaccatccgcatggctctggggcttctggaggaaaaaggcttcatcgtcagaaagcagggaagcggctcgttccttacaggacactcctccagaccgcagggaaatgtcatcggaattctcatttccagcgatcaggaatacatctatcccggcgtaatccatgatatccaaaacacactttctgaacatggcttcacgggccaggtttttacaacgggtaattccatctccagagaacgggatatcctgctgcagcttctgaaaaaccctctgcgcggaatcatcgcggagggctgtaaaagtgcgctccccaatcccaatctggacctgtaccgcaggctggtcaaaaagggctgtcagatcgtgtttctctataattattatccggccctcaccggctgcctctttatcaaagacgataactattcggggagcgccctcttagtccgccatctggccgctcagggccatacggccatcggcggtatctttaagtctgatgatatgcagggaatcgagcggtatcagggcttcacggaaacgctgcgcgacttagagctgcctgtctccgaccacagcatctgctggtacagctcccgtgatttagaccggctgcttcacggaaaagatacacagtttttaaaggaaatggcggcggagtccctttcctcctgtaccgcagtcgtctgctataacgacatcatcgcctattatctggtggatgaactccagtccgcaggctaccggctgcccgaggacatggccgtggccgctttcgatcatacgtatttcagcagctccaatattctagcggtgaccactctctcccatgagccccatgagatggggacaaaggcagcggaggctgtgataaaaaaactgagcgggcttcccgtgtcttcacaggaaacccgctggaacctgaacttaaaggaaagtactcagactgaccggtgatgctccggtcagtgcttcttttctgcacggtattctctcggactgcatccctgcagctttttaaagacgaagctgaagtaatgggagtctttataccccacctccttcgctatctcaccggaatttttgtccgtctgctttaacagctttttcgccttttcaatccgcttttccgtcacgtattcaacaaatgttttctgcatgttctggctgaagatggcgcttaaatagctggcgctcatgccgatgttctcggccaccaggttaagggacagcgtgtcacagtcgtagtgatcgtctatataatccagtgccttcttcaacattttcccgccctggcagctgttgatccggtcccgaatccccatcgcggtctccagcatgcctgcaaagtattcgaaaatctcgctgtcctcactgcggatcatctgcaccgcatgctcgatctcttctaaatactccgcctgatccgcgccgatagactccaggaaagcaacgacggcaaatcggatattcaggatcacatagctgcggaacatcctggattttaaggcattctgaatgttgtaaagataggattccacgaaatcatgaatctccttatcttctccccgtgacagaaagtcgcggataatctccggatccatctgcataaaatccaccgtgccgatattcttttcgccctgtccggccagacagtccgaaagcgtcgtttccgacagcacatggagacccggcttgataaaccggtaggcaaaatagtggttcgcatctttatagcactgaggcagcatgctcaaacgctccacctccgttcccaccgcaacgtaccattccaggtgatcctcctccggcgcgcagaccttttttaaatgggccaggctgttctctgtcagctcctccatctgggactgctccgatttgatcagaacgccatagcagctgacattgaaacggaacagaatatactggggatgccgcagaaaatagtgaaatacctcctcctgttttctgatcagccgctcccgggactcccgggatgatacctcggctttctcatagatggagaaaagcagtagattgtaacaggaggccgtaagctgcagcgactgggctgccgcctcctcgtagatctccttcaccgaaagcttcccctccagaatcttctcaaagaatctccgaagcgaaaactgttcaaattcctgcacctcatcctggtattgggcctgataatccttctgctccatcccctgctcgattttttccttcatctccagcaggacgccgcggagagtcgttctcgtaatcggtttcagcagatactggtccactcccgctttgatcgcctggcgcgcatattcaaaatcatcatagccgctgatgataatgatctttatcttgggaaattcctctttcacgatttcactcaaagaaaggccgtccataaatggcatcttaatatcggtgatcagcagatccggcttcagtttccggatcatcggaagcgccatctccccatctccggcctctcccaccagctgaaacccatactgctcccacggaattttatcccgaaacccttctcttatgacgctttcatcttccaccagaaatacttttaacatttgcttcctcttttccattcacaagtccgtttcccatcaataagtcctcttctccagggcgtccttcacattttcctttgtaaataccgtttccggaacaaaatacagctttgccacggcctcgttgttctccagttttctgatgaccgtttcaacgtattcgccctgattgggattgcactcgatgtccgcggtaaccagcccttcatccaccagctgaagcccgcttttcaccgcgtcaaaggagatgaccatgatgtctccatcctctccagcggtaagccctgcgttctgtatggccgtcagcgcgccaaaggtcatatcgtcgttttgtgagatcaccacatcgatatctttgtaccggtgcagcagcatttccatctcttcctgtccttttgccgtcgtaaactccccatccgcctgctccaggatcagccagttttcgtgggcttctgcgacttcattgaatccgttcgtgcggccgatcgtggccgtcgctccctcggttccctgtaaaaccacgatgcggatgctctcctcctgcctgtgctgcttcgtcaggtactcgtccaggatatttccggccattctcccctccttgtaaaaatcggagccgatccaggtcgtatataatgactgatcgctgagcttcactttacggtcgattaaaatgacaggaatccctgcctccttcgcctcctgcagcacagtctcccagccgtcttctgtaatcggagaaaacacaatataatccacccgctgggagataaagctccgcagtgccttaatctgattctcctgcttctgcctcgcgttattaaagatcataaaatatccattttctttggttaggatattttgaatggaagccgtattggcagttctccacacggattcactgcctacctgagacactcccaccacgatcagattttcatcgactgtattttctgtatcttccatcccgtactcttttacacagccggacagaatcagaatcagaaacagcagaggaatgaaaaaaatacgtattttctttgccggtatttccatatgtacttaccctttctatactttccgcagcggacgctcgtattttcatgagttttatgttcttatttcattcatttatccaggaacgtcctccggcagactctcataaattttaatcgccggtattgtaagttccacaatggttccttttcccttttcagactctattttcattccgtagccggagccgaaatacatgcggatccgctcatttacatttgccagtccaaatcctttttccgtctcactgcagggacgctcgatttcccttcgcagctgctccaagtctttctcatccataccgatcccattatcactgaccgccaggtggaggacctctccggttttctcacagctgatatggatgcagcctctggagcgcttatattttatgccgtgatatagggcattttcaaccaatggctgcagcgacagcttcagaatctgataatcatacagctcctcgtcaatctggatatcatactccaggatgtcccggtaccgtctttcctgaatctttaagtaactgctgatatgctgctcctcttccctgagcgtaataatctctttccccttgctgagcaccagccggaaaaagctggacagggacactaccatgttcaccgcctcatccgccttctcatcctcgatcagccagacaatcgtatccagggtattatacaggaaatggggattgatctgttcctgtaaaaggcgcaggtccagccgccgcatcttttgctcatcctctttgatctgcccgatcagagtctgcatattggccgccatatcgttaaatccattggccaggatctctatctcatctttcgaacagacgtcggcccttgctgataaatcgccctccgagacctgtctggtcgcatcatacagcactttaaccggccgcagaataccggttgtaatccgccatgtcgctataattgtcaaaaccaccagaaacagcaccaggagcccgcacacgatgataaagctctgcatctgctgcttcaaattccctgtgaccacctccatggccttcgtctggtaatagatataatactggatatcgtcctgaatcagttctgtcaggatgtagatgttattatccagctcctggatattttcatcataccgcccgccgattctgatgttctcgaaaatatcatccactctcttttccagggtgtcgatattccgcaaaagggtctccagccacacgcggctctccgtctctgtggtgatatccttcagcttcgtaaactccgcccgcagctctccgattaaggcatagggatcctttaacgtctcgtcctcagaaatatttccaaagtctacatatcccaccacaagcttatagaggctctcgtccatctcatctttaaaattcagattataattattggcaatggtcatatcgctgacgatcttatcgtacactctgctgtactgaatcatggaaaccagcagaacgaccaccacaatgaaaaatggcaggacaatcgccgccgcaagcatcaatatttttttgttgattgaaaaccggatcgggctcttattcgaaccattttgccacaaagcgtcacgtttcatctctttatcccctaagtaaaacattctctgttcatgggtattatacaatgagatcaacgcttaagcaataaaaagcctggcggcttttcgcggggagctgatgatgcatgggggataatgcaaagttgtgaaagggcggcagcaaaaaaaggccggaagctgcgaaagtaggattacatcatttcggggcttggggcctttgggtttatagtggttttctgtcgcttttccgttgtttctctatattgattttatactctcaagcaattagttatatgctggagtatgggatttcacagtaccagcttaatttaggctgaaagacatcgcggtttcagactcgccggactttttccattcccactcctcatgccactctgctacaagactggcatcttccttacaaattacagcgatgtcttctatacacaaatctctctcgaataaatttatggccgcttcacggtgaccatccctcaatccctcttccctgctcgattccttctcactcgctatatgcctctgctcatcatactctgtcagcagcacctcgaacacctccgctctgtgtgatgacaaaaattccgccagtatcccatcccggatgcaggaatcgattacttctccaattgcttccagaagatcggcacctgctttcagccattccctgattcgcgccacgaattccgcatactcccttaatgcagaacactgttccttcaggcttttattgtgcccccggttaatgttcaccataaccgctttacattccatacacggttccagttccggatgaagcgtggaaaatgcattggataacttcaactctacatagtccggctcttcttctgtattcctccacaatatagaacgctccacggaccggcatatttggattccatgtagactggtgttcccacagattcaggacgtcgtcgattaaaaatgcgagatcattcttcattttcatataaatcacatcatcgagcgtatgaatctccaaatcttcaggatttgtatactcggaatggctgacagcattatacagcgaaagcagctcctctttccggttaaataccatgcgaaataatctgtccttatactttttattaacttttaccacgtttctacctccattatactcaaatagctggtactttacaatagatttttactatcattccatagacagaccactcctcccactttctaattccaaacaattgtgaatgctttggcagactcgccgtgatgccattgatatggcataagatatcgtgacgcataagaaaatgcgtaatagaagtatagcatgattattacataaagtaaatgaaagaaaagtctgatttatgccgcggcagccgctcctctctaccggatgatcttaagatcttaagaatagagctgcttctcttacaggcttaactctgcttctggttctctgcctgtttcgtctgaacaacaccatttacggtccactcaccatctgcattgacggtactgccgtcaatgacgctgtctttcattaatttgccgcaggttccgtcggataccgggttaaaatagttgtgattataagaactggttaaatttttcaatgtgtctcctattatactatatacaattatctttttcaatccgcttttttctgattttaatacatttttcctgtgtttcagccgcctgaagccggaaatgaaaccggcagcgccatagtaacaacaaattcttcctccgtatattccacatggctatatccgccatacttcttcaccacccgcttcatgttcttaattcccagtccatgcttcgattcatccagctttgtggtctggatgctgccatgcttcaccctgaccggattcgttttggtgttctttatttccacccagatcaggttcttctttctggatatagtcaaagcgatccgacgtgccagactgctgtctgttatctcgctgcaggccctgaccgcattttccagcggattttcaaagatggtgtagatatcaggaaatgccataaaagaaaagtcggagaacaggatattcgtatcaaattggatttgcgcggaatcacagcaaagctgtgtctggcacaggatcgaccgcagagccggtgaggggataaaggcgaaccggtaactgtcttcgatatgatgaagcatttcatccgcataggaccggatatcacgctccacaagctctccctccccgccgcccgcaccctcctgcagcaggtgttttatgccatcgatctgtttcgtataatcgtgagccagtccctttaactcttcaataaacgcatcctgctgtccgatcaccacccggtccagctgttcgatgcgggacagtctgtctaattcgtgctgaagctggcagcgtttccgccaatggttgtcccccagaatcaccgccaggttcatgaataagacgcccagaaaaaagatcatgcttagggaatcggcacggttccccagcttcgtattcaaaccgagaatattaaatacatagtatataataaaaatactgactacggggactgtgataatcgacagattttccgttatcgtaagctccgtgttctcctttctctgtttcagccaatggaaatagcggacaaccaggaggatgacacagaacatgccggtgctgcagaggttaaagcctgcatttttaatggtatcatctatgacggcaatcatattcaccctgatcatggaggcgtagatcaaaacatggatgctttcacagattaaaagcagaagaacctcaaagaaggaacagagaagcctcgcggcgatactgcccttgaagagcatcaggtttaagatcagactgcagagaagagcagtcattgtattcagctccggtatgtacagtaaatttatgagaaactgaactgtagacaggcctaacagcagtccccaggagaccagccggcgtttctcccatctgaatgtgaagaactgcatggtgaaccagaaaagtaaagcaaaatccagaatacatttgccataggctaaaatcgtgtcaagcatactcataccacctttgtatctgcgttgtgcttcagatatctgaattgtgaagcagcgttttcataaatgaatcccggaaatggaggcccaaaggcgcagcgctgtggtctgtaagtaagattttgctgtcgttgaccgtatccaccatatccagattgacaatgtagcttttgtgtgaatacgcaaatttgtcggacggcagactgtccatgagctcacggagactctgccatgtgccgatctgcgctccatcctggcacacgatatgccgtttgcggagtttcgaataaatatacatgattttatccgtccggagcagattggtatgagagtcattcgtaatctttatataggatacggagcggtccagcttatgggcgcaggcgttgaggacggctataatctcctcctccgtaaatggtttcacaataaaccgaaacggttccgcccggtatccgtctatggacatggatttcagagccgtagtcagaatgataatcgacgtattcccccgttttcgcagttcctcggcaatatcgatgccgatgcttctgttcccgaaccggatatccagaaacaggatgtcataaggattcgtcaggtcatacagtttttcggcggcatccagctcaatgagatcgatctccacgtcatatgcgaaggaataccgtaatatatattttttcagtttgtcgcgtatcagctgttcgtcgtcacagatacacaccgtatatttcttcatgtatcaattctcccccattttttggtatcttttattataccttacaaactccgttatgggtagacgctaattgctttctgatataaagttgcggattataaaatgcggaacggatgaactggtattgctatcctgttggatcactcagcgtacgcttcataccacaccgtttcacacagcggccttctctcctcttcgtgccgttctgagtccaaaaagcctttgctgggatacccaaggaacaacagcgctgtcggctctaaatattccggcaggataaattcttttgttataacagcaggatcaaacaagcctaccatgacacttccaatttccaactctctcgctgccagcatcatgtggtcacagacaatacctatatccagatctccggaacactttttatcataggggcggatcaattctccgcgcctgtcccggcagacgatgagtgcgcatggagcgtcaaaggttcggtacgctttttctacctttaccatgttttctcttctccggacaacgatgattctttgcggctgcctgttgcaggcagttggggcaacccgtcccgctgacaatatctgttccagatcttttgacagtatttctttctccataaatccacgtgtcgtacaacgttttttcgctaaagttaaaaagtccataatatcctccttcaaaacatgaataatacttcacatttataatcatagcagggatttcagcagacgtcaataaaatgcgaataataattcacattttattgacctggggcaggaccccatgtataataaaaaagaggtgaggatatggctgataagagaattcccgtccagagacggtccatagaaagaaaacaaaagattttaagctccggttttaaacttttttgtgaacacggctactacaaaacaaataccatcgagattgcaaaacacgccggtgtttcaaccggagccgtatacagttattttaaagataagcgggaaatatatattgcagcatttgacagctatctcgaagaaatttcgggacgtttatttgaagaactggaacaatctcagacgcttccattaccggatttcgtggaaaactgggtcactgtatatctcgaattgtatgcagactccgggcacgcgttagcacagttaagaatgatgatattagaagacgaagagatcaaccgtcatttttcagatttagaaaatgaatattttatgaagctgatccggctgctgaataaaaatggtgtggaacgaaccgatcttatggagacgatttatacctgttgtattttgatcgatgcattgaggcaggagcagtcctcattctcacatatcggcctgaattttttcatttttaaggaacaggttaccagtacaatccttcaattattgtccggctgaattgccttgtagtccgcaggaaataccgggagaacgccggaaatactatactggaatataaaaaacgagccattaacagataagttatggttttatacagcgtggagaggggtatttatgtcgtcagtaaaaacgggtaagggaacaaacaggagcagtgattccatgttgttgccgcatatcatcgatgtttatgtgtttttgattctgtgctgttttcccctttttgttgtgaatcagtattatgaactattgaaggtaaaatattatttttatatcgggtcagtaatttttctgctgacagctgcattaatcgccggtactatcgggcagagtagtctgaaaacgtattttgcatcttttaaatggaaggattttataaagacgttttccaccattgataccgcacttttggtctttctgctcatcgcaggcatctcaacgatccgttccgattacgtgtatgaatctttttggggaaatgaggggcgtttttccggactcttcctactcagtctatatggagcagcatacttttgtgtaacaagattggggaattttaaaagatggtaccttgatgcatttttagccgcaaatttactcgtttgtatatttggtattacggattactttcagttggatctcctgcactttaaagtgggaatggcggaaaacgaaaagtttatatttacctcaacaatcggtaatatcaatacgtatactgcgttggtcggaatggtaacggcggtgtcggccgtattgtttgcagcagaaggcagatggaaaaagaagtgtctgtactttgtcagtctcattatcagcatctttgcattggtcatggggatcagcgataatgcctacctgtcactggccgcgttgttcggctttcttccgctttatctgtttcagaacaagaagggtgtcaaagcctatttattaatcatcacttcatttttctcggtgatccaatgcattgactggattaataccgggctgggaaccagcgtgccggagatcgacagcgcgtttcagatcatatcccaaagcgatggccttctctttctcatattacttctctggattctctgcgccttcgtttgcggaccagattttgtaaatgcccacaagaaaaacatgtctgcctctatgcagactcatattttcagtaaaaatgaatataagccgacaggctgcagaggcttgcaaagaacctggatggcacttctggtactttgcattctgggtgtcggatacgcactcgttgacgttaatttccaaggaaacgcagaacggtatggagctcttggcagttatctgctgtttaatgatgactgggggactcacaggggttacatatggcgcaatgccatggaatgctttaaccagtttccattgaggaaaaaaatcattggcttcggccctgatacttttggaattgtgttattaaataagacaaaaggaaacatttacggtcagacatttgataacgcacataatgagtatttgcattatctcgtcacagtaggatttgccggattaattgcgtaccttgcctttttgatttcttttgcagtgagagtcattcgcagagccaacaaaaaccagtatgtcacagcggctttttttgcagtgctctgttactcggcgcaggcatttgtaaacctgaatctgccaattgctacaccgattatgtggatgcttctcatgctaggcgagcttggtatacgggaaaataaggattataatctctgcaaaccggtctgaatcaccggtctgcagagcatacgtcgttttttgtcgaattactgtatgctccttaaaaacttttttagagttataatctaactataaaaaagttttaaaaggagagttcttatgcgcgacttatcagtatatttttgtaaaaaatgcgggttttattcttattatcctttagccaaatatgcggtctgtccgagatgtgatcttgatatggtgctgctgccaatagaatataaagaattcgtcaatctaaactgttatgaacgcgatgaattacttgctgatcaaatgattgcttcatcctctcccattgttcgaagaatcattgctccgcataagataaataacactcgtgaaatcattgcaattctcacttataaaatcgacgaattaaacactgaaaatgtaaaattacagggaaccgtagattggatgcatcaattcatctggcagttagtaaaaagcagaaaaaatataactccgccctagttctcgtcgcaaagataggaaaccaatatagaaataaatgcagcattattcggtttctttctcaaaggggtataggcaatatgttcgagcagtgaccggtcacctttattccatattaatgcaaccagcgttctgatatttctctctacgcattgtactgatgtatggtatttctttgctacctctggatataaccatttcgatattaattgtaacttatctccatcttctatggataattgtactgcagatattacatagtaaaatcctgtatatgatcgattcgctccaagccgtagcaaaagattttctatctctctttctctcatggcttttctcctctccctatcaccttcaatcatactatggaaatttatggcaaatcaatcgatatatcttgacttttttcgacgtatatataaacgttgagagtttttatttataacgcctgatggaagaatatcaaaaacatcgatattaaaataaaaaagggataccgtctgaaacagcatccctgtcaaatcatataccgccaacagcccccatcgaaacaaccgctatacggttcagccccgaatttcctctctattcattcccataatcatccacaacccactcagacgtctcgccatcccggatcaaaatccagttccagtccgtatacacagcgttcggttcaaaactccaggtattttctcctgtttttaaatcggacagaatgacaatgacatcgtcccgtttcactccattcgaagcgccgcggccgtattccatatacgaatcgatgatcctctcagaccgctctctgtcataccacaaaccagtcagcgtacagtcctcttcaaaggtatccatcttctcacgtatacacgcttcgatgtcggagctgaccgtttcacggtttgaggcagcagattccatttcagcagatgtgcgttccatatcctttttattgtccgcggccggatcactggtcgcgccggtatcggtatgctggatgagtggttcgtgactcgtcgtactgtcggttttcccggtacatccggttaatgcgagtacgcatactattagaactgcaggctgcagtaattttttcgtttgatttctcattctatttctcattctatttctcattctatatgtcattttatttttcatcttatagagcctcctgttctttacgtcttatccatcccacattactatcccattgattattctgaattcgtatccatctgcgatttcacaaagtggctgcgtccggccagtacaggtttatctgcttcatcccatcaaaatactttatttcattataatcgattgtccacaccattacctttcttttttcttaaatatctttttcttaaatatcttttttctttgcttaccataatcaccatcccctccaaagcacggttattcccttgtattcccaaagaatatttgctaaaatcaccatattacaaccgctcgggagttcccgcctattaggatgccggtatgaataaagaacatgattaatagaaaaactctgaaaaccggcggcatacaaccggctttcagagtttttgattatcccctcaataccttctctctttcatcacttcccgcgcatccgtctgatcatacaccttttcctccgtaataatccgcagcggcagttccttcccttccatcaggtcctgcacggccttcatcagctgcgggccgagaagaggattgcattccacggcgcagttcaacttgccgtctatcatggcctgaaaggcatccttcgtgccgtccaccgacacgattaccacgtcactgcccgcgtggattccatgctcttccaaagcgttcacagcgcctaaagccatatcatcgttgtgggcgtagatcacatcaatgtcccatgggtagttttcaatataatcttcgatgattcggcggccgccttcatatgtaaagtctcccgactcggaataggcgatccgatagccgggattcccggccatctgttcctcgaaaccgcgcttgcgctccacggtaggcgacgcgcctaaagttccctggagctccataatcttcaccggcccatgctccggcttcacattagcggcgatccagcgcatggcgcgccggccctcctccatgaaatccgcgccgatgtacgtcaggtacagcccgtcatcctctgtctcaatccttctgtccgacagcagcacgggaatcccggcttccctggcctccgtcaggacctcatcccagccgctgtccaccaccggcgacagaacaatcacatccacttcctccctgataaacgtgcggatggcttcgatctgcctctcctgctgctgatccgcatcctcaaaatgaaggctgatccccgcctccctggccgcgctcttgatggactccgtattggccagacgccaggcgctctcggttcccacctgggagtatcccacctggatcgtgttcctgtccttctttttatactgctcccacttcacctcgctgtccacattgtcgatggtaatgttgtggctccgcagaatgacctgtttgggaactccggagacttcgtttaagatatccatggcataccggatcgcctcctttccgccggtggggcaggtaatggtctcgctcagctttccctgccgcaccagatccatgcctccattggggccggaaaatccgtccactcctataatttccggggagtaccccagcttcttcaccgcctcatagaccccggatgccatgtaatcgttgtgggcaaacaccacgtccacccccgccagccgttgtcccagctccagaaataagtcctccgcctggtccctggactcctgctccacacgaaactgttctctgacgatccccggctccctggaaagcaccaggtcaaatcccttgcttctctcggcactggaaatggaattctcgcttccgcagacctcgaacacagtcccgccctttcccgccagtcgtttcgcggccccttcgccggcctgccgtccgatcagttcgttatccgggccgataaacagcgtgtaatcaaagccctccacgccgcggtccatgacgataaccggaatcttctggtacacctgcccaatcacatccgtcatctccctggcatctccgggggagataatcagaaggtcgatatcaaactgcatgagtctctccacatccttcttctgcttttccccatcagaagtggcgtcggtcatgatcagcctgatattgggatattccgctgccgcatcctcgatctcactgattaatgccagcctccaggtctcacgcatattggcctgggagactccgatcacatagtccacctgttcgatctggccgcggcctctttccgtatacagccaccagactcctgctgccagcagaatcaggagtgctgccgctgccgccatccattttctcttcatcgccatctcctatacaccgtcttcctggatcggaatatggatcacaaccttcgttcccacattctcgatgctgttgacccggatcttaaatccgtctccgtatttgatccgcagccgttccttgatatagaacagtccgaagctctgccgctcctccagctcgcagggttcatttaacagatggttcagttcctccgcctgctgtgcgctcatgcctgatccgtcgtcctccacggagaactccagcagcccatccgcagttttcacggcccggatggtgagatgcccttccccccttctggtcttgatcccatggtagattccattctccaccagaggctggagcatcagcttgggaacctcctcatttaagatttcctcatccttgacgatctggtaattcagcttgccgccgtagcggatcttctggatatacagatagttggccacataggaaagctcctgctccacgctgatatagtccctgccgcggctcagcccgatccggaacatattggtcagcgcatccaccagccgcaccacatccccggccccgtaatccctggccatccagcttatggtgtccagggtattgtacaggaaatgaggcttgatctgttcctggagtaccttcagctccgccatccgcttgttcttctgctcgatgtatacctgctggatcaggtcctcgatccgcacaagcatatggttaaaatcacgccccaactcgctgacctcgtcatggtaatctccctgaaagcggacggccagatccccggactccgcctttttcatcagctgctccaactccaccaccggattcgtgatcgtctgggatatcttcaccgtaatcacaaagacaaacgccagaagcagtagcaatccgcaggtaagcgcgaaaatcagcgtattcatgtgccccataatctcgtcgatggagaataccccgaccacacgccagcccgtgtaatccgaacgttcgctgcggatctggtacttttctccccgtattctggcggtcacaggcgcattttccttccggatccagtcgggattcacccggtaggtaatgggattggccggggtgtagaccacacggtcctccgaatcgatcacgaatacaaaccccttctgtccgatcgtaatattgtcgatggactgggaaatgatatcgtgcttgatatccatgagcagcacgcccatgacctccgtggttccttccttatagattgccttcaccatggaaaatacattatcaatgctgtagctttcattggtcacaatattgcggcccgacgtgtcgctgatcagacagacggtgtccggattgctgaccgccagcctgtaccactcctcattcacgaaggaatccctggagatacgggtcatccccgtgctgatatacaggtcattctccgtggcaaacagaattcctgccacctccggatgggtattggccacatgcttcagcctggcgactgcctttgagctctcctgcatccagaatatgtcgtcttccgtatacatctcattgaaatccacgcttctcagctcttcgatcacatagttggagattttttcaatactgctgatatagacatcgatggaggttctcacctggctgatcatctggcccgtgtgctccgagatatcattttccgcctgtccggcaaaaatgctgatgaccacgatcccgaaaatacagaaagggatgagtgcaattaaaatgtaggataaaatcatcttgtttcggatagacagattcatgattttattcttcacaaatttcattgcactcacccctgtatcattcttctaccagtataacagcaatggtactgttttacaattagaacctaccttcccttcgctttttcggcacgtatggagatgatcctctggataacgataaagatgcacagcagcgccgcgatcgtcaccttcgtccaccatgtattgaggttctggtagatgacaatcgtctggataatgccctggatcagcacgccgatggcggttccgataatactgcccactccgccggtcaaaagcgtgccgccgattacggcggaggagatggcatccagctcaaggcccatattctggagggaatagcctgccagcgtatagaagctgaagacgacgccggccagcgccgcgcagaagctgctgatggcatagactgcgattttggttctggccaccggaagccccataagaacggccgactgttcatttccgcccagagcgtaaacgctgcggccgaacttcgtgtacttgagcacgtaaaaggcaaccgcgattaccgcgaaggcgataaaggcataggagtataattttccctttccaatcatgactctcgtaagggccattttcttataaaaggagttgctgatggggatggactccgtgctgatcaccgcgcacagcccccgcatcaggaactgtcccgccagcgtcacgataaatggctgaagcttgaagtagtggatgatatatcccatggaggctcccagcagaaggccgatgataagcacgagcgcgatcacgaccggcgccgaaacgccccgtttcagcatatacgccgacagcacgcaggtaaacgcgatggtggacgcaatggagatatcaattccgcctgtgagaagcacaaaggtaaccccgatggccgctatgatcagatacgaattgtcattgatcagattaaacagcgtagagagggataaaaaccggtcataccggaccgcaccaaacgaaaacagcgccacaaacagaatgatggtaatcagcagcgatatattattgatctttactttctttccggaccgttccttcatgccccctgcaccgcctttcccttatgaagcagattttcgatttgttccctgaattcctttgactggaacaggcagataatgacaaccagaactgcctttaccacctgtgtgatctccggggcaatgcccagcgcatagacggttgtcgtgatactctggataatcagagcgcctgcaatgctggccggtatcgaaaaccgcccgccgttcagtgaagtcccgccgatggctaccgccagaattgcgtccatctcgatcatcagtcccgcgttgttgcagtccgcgcccttgattcctgcgctttcaatcagccccgccaccgctgccagcgttccgcagcaggtgtacaccagcagcttgattttatccacatggattccagcaaatttactggccagagaattgcatcccgtggattccaggaaaagcccaaatgcggtcttcttcgtaaagagaatcagaatgattacgacgaacagcacgataaataccggaaacggaagtcccagaatatagccgccgttaatgaaataataggcgcctgaattgaccgtaatgatcttgcccgacgttatcagctgggcgataccccgccccgccaccatcaggatcatggtagctacaatgggctgtatcttgattttagctaccaggaagccgttccacagcccgcagagcaccccggccgccaccgccgcgcagatggctacagccacactgcctccaaccgccgggaagaggctgccgctgataatactgcatgcaaccgctccgctgatggccatcacagagcctacggagatatcggttccacccgtggccagcaccatggtcatccctgccgccagaatcatcagcttacttccgttccggatgatatcgatcacccgcccgtagagatggccatccacgatcttcatctggaaaaagctgcctcctgtgataatcccgttaaacacaatgatggcaagcagaatgacaaatggccagaacgcctggtatttcgtcagcttactccactttttcatttgcttcacctcccgctatatagcgcatgatctcgccctccgaaatctcctgcccctttaactccgtaaccttcttcaaattacgcagcactaccatccgtttgcagcagcggagcatctcgtcgatctccgacgaaatgaagaggaccgacatgcccttccgtgctaaatccacgacgatcttctggatctccgcctttgttccaatgtcgattcctctggtcggctcatccagcatgagtaaatccgggtcggtggccagccatcgggcgagaatcaccttctgctggttgcctccgcttaaattcttaatcagctgatccctggacggcgtcttgatctccagcttttcaatgtattcatccgcaatgcactccgcctcctgtctggtaatggcggcaaacatccctttctttgcctgaagcgccagaatgatgttgtcgcggatggacagatcgccgatgatcccctccgtcttacggttctccgggcagaaggcaaccccttcccggatggcgtccagcggagttttcagagcggcttttttgcccttcatcttcagctggcctttttccacctggtccacgccgaagatcagcctggctgtttccgagcggccggagcccagcagccccgacagacccagcacctcgccccgccggatggtcaggtcaaagtcctcgatcgtgccaaggccggagacatgatccatttccacgaggatctccccgtcctcccggctcccgtcctccgaagccgtcactgcattgagcttgtcgtaatccttgcccagcatctttccgaccagttccacccgcggcagatgctccgtctcataggtccccacgtactttccgttccggagcaccgtaatcctgtcgcagacctcatagacctgatccaggaaatgtgtgacaaagacaatccccatcccctggcttttcagcttcttcatgatctcaaacagcttttccacctcagcggtcgataaactggaggtcggttcgtccaggatcagcaccctggcggatatgtcgcacgccctggctatggcgatcatctgctgaattgccacggaatagctgtccagcgtccttgtgacgctgatatccaaatcaaacttctttaagagggcggctgcattggcgttgatggtcttccagtcgatccgccctccctttaccggttccctgccgatgtagatattctccgccaccgataagttggggcagagattaacctcctgatatacggtgctgatcccggcctgctgcgcctcctggggacttttgggataaatctcattgccctctaagaataccgtcccggcagtccgctcctcgaccccggtcaaaaccttgatcagagtggatttgccggcgccgttctcccctaaaagcgcgtggatctctctacggttcagccggaattctacatcatccagggcaatcacagcggcagagaaatgctttgatatatggttcattgttagaagctctttcttctcttccatgcttcctccttctttcttccccttcatgataaaaggacgcaacagtgttccgctgcgtccccgtactcaaatggtatcgattaatacttacggtttggcagatctgctgccgccgtatcctggcgatagatgccttcatcggattttacccatttctcaacaggctctccattctttaacttcatgcaggtggtaaagaactgctcgcccagaagagggttgcattcaaccgtcacattcgcctcaccggctgccatcgcttcgaataatccctttacgccgtccacagacacggttttgatatcaacccccggcttaaatccggcttccttgatggcctcgatcgcgcctaacatcatatcgtcgttgtgtgcatagacgcccttgatctgatcgccgtatgtctttaagaaggattccataacttccttgcccttggctcttgtaaagtcgccggtctgggattccagaatctcgatgcccgtgtggtttgcggcgatctcgtcgtcaaagcctttctttctgtcattggccgcagatgcgccgacggttccttccagctccacaatcttgccttcgccgcccagtaaattggacatctcaatcgctgcgtttttgccttcctcgatgaagtcggaaccgataaaggtctcatataagctctcgtccacgtccgcttttctgtctaccagcacgatggggattcccgcgtcctttgcctccgtaaataccgcgtcccatccggtctcaaccaccggcgccaggccgattacgtctacgcccatatcgataaaggacttgatggccttgatctggttctcctgcttctgctgcgcgtccgcaaactttaaatcaatcgtatctaaattctgtcctgcataaaactgaatggaagccgtctccgcgtctctccagccggattcctgtccgatctgtgcaaaaccgactaccagtttatcattgcccttactctccggtttcgctgcttcagccgccggagctgtggtcgctgccgctgccgtatccgctgccggagccgccgtcgtggctgccgttgtggccgctgtctcctgctttgctccgcaccctgccatcattgacgccgccattgccgcacataaaaccagactccatgttttctttctcattaccatttcctccttcattttcccgggttttctttccctttgttatgtatctattgtagtaaaactgcgcaaaaaagtatttacaataaaaagggaggaacatacaaaaaattagcacgcatccggaggcctctcctgacgcgtgctaaaatatcacatattgaaattaaaatattataaattcgtattttttatggatttccggtactctgccgggctgactcccatgtttttcttgaacacattgctgaaataatgctgcgtcgcatagcccacgttctctgcgatctcgtacatctttaaatcgtcctgatagagcagcccgatggcctttcgtatccgcacccgggtcagatagtcaataaaggtgattcccatctccttgtgaaacatcctgcttagatgctggggagacagatgcatctcctccgccgcgtcctgaagggaaaattccgcttccatataatgcttctcgatcacatccttcacgctctgcacggccgacgagcatcccttcagctggccgatctcctccgacagcgccctgcacacctctggaaatgtctcatgcccgtatcccttcctctgcatgatcaatgccttgaccggcagaatttcctccaggacctgcgaaaatttccgttttttctcctccgaatccgcgcagtcagccgtaatggctatcaggtcgcctgaatcgttcctgagcgtcgtgatcccctgcagttcattgtagatctcattgcagatattgcgcgctgcgtaatagagcaggtcatcgtcccactgcccgtcgatctgcgccatgtcccggtactgcagatgcacatagaccagaagaaactcctcgggaaattccagtcccagataccggatgcgttcctcggcctcctcggcggaatagtgaccatccagccatttttccagaaaatccgcagtcagcatgtccatattctgtttcagcgtctgcctagcccattccagatagtccttagcagccttatcctcccgaagcttgcctaagaccttctggatcatctcgtcaaagggctgttccatcacaggctttaagaggtattcaaacacgcccagccggattccctcccgcgcatactcaaaatcgtcatacccggttatgataactaccaccgtcttcgggcttatctccttcagctgccggataaatcccaggccgtttaagaagggcatattgatgtccacgaaggccacgtctatctcctgattttcaatgaattccctggctacctccccatcctctgcctccgccacgatttccatctcttcatacttgcggaggaagcggataatccccctcctgattatgtattcatcatctgctaccaacaccctgtacgccatcgcacaccccttccggcatccttccgccccatatcattcttgttttatcatacaccctttccccctgaaatgtaaacctccgactcctcatcggtcgcctccactttgaatatcacagggcgcaggccgtcattgcagctgcatatggccactcccggcttccgaatccagtctccgtaataaaacagcccatcccctgcgccgtgggaaagtgcaaacacatattggtaaatcgccttccacgcctcgtcgcaaaagccttccggcttcgcataatcggcccagaacacctggccctcctgcatcagcgggcaggccttaagcccgggaacaccgtattcctccgccagttccttatccagagttgtttttaagattgttattctgcattttttcatatcaaattccttcctttctgtctggcaggacaatccattgccgccctcctccgtttatggtatgatggacccatatccatgaaagaaggtgtgccaatgctgattccccgctactacttttccaatgactatactgatttttatgagtattttctcacacagccccataccagaaagacatttcgtaaaaatgactgtctttggaatcccggtgaacccgtgactcacgtctactacatcatatccggcatcgccttaacggttctggagcatgaaaacggctcccgcaagatttcatccctgcacagtgcaggcaccgtattcccaggcagtcaccggtccgtttttaaaatagaacactccatatccacgatcgctttatccgacatggaaaccctgtgcttcccaaatgaatactttcttcagatgatctgtgagaataaggagctgacgcttcggacgctggactggaatgcctcctacatcaatttactcctgtacgagagcgcccatcaggattacaataactcctttttaaagctgtgcaacttactctaccttttctcccagaattccccggaagaaaacggccgccgcatcagtctgacccaggaaaatatcgcggagatcctcacggtaacgcgtgtaaacgccgcccgcaatctctcgcgcctgcgggatgagcagatcatcgtctcacaccgcaaatggatcgaaatcatcaacccacaggccctggaagcttactgctctcaggaaacattaaaatcataatctgatctcccctttcctggtatcagtatatcggaaggcgggagatttttctgtatacaaatatacacaaagaaattcctccaaacgcccgccgtcccacattatgacccggtttaactgaaaattgaaattcggctgtggattcaactgatacagccctttcttaaatgaaaattcgcttgctttcaagccatcacctccctaaaaataaagacatggattccagaaaatattgttttcctccatgtcctcattgtaatagatccgggattgattagctttcaaatagacgctgacattttatatcatacacattacaccgccccgttatatcactggcggctataccaaggtattttctgctggcggctgaaaaatgggacggtgttccgaatcccgcattcatcgccgcagcggtgatcgtctccccttccagcatcagctgataggccttgcgcaatttcgccagcatcaggtaactgttgagtgacactcccgtctgctctttaaacaagtgggaaaaacggctctgcgataaatgcgcgttctcacacagccgggatatcatggcgccgtctatatccgcagactgcgatataaagccgagggctgtctgtactctgggatcgggaattatggtactttttccatttaaggacagccggcaaaaaacgaattccgaaaactccgcatattccgattcaaaacgatctggcaggcaggccttatacgcttcgcggatctgttcgacgatccgtccgtctatcactttaaagggctctcccgccaacggatcatggttcatattccgtgccaccgtacttgtggcatcgatcagaaaaaccagcatccggttctctctgcccgccacggtatgcggcacgttggcatcaatcataacccccttacacacggcctttcgctcgccctcaaacgtcacagtcagatcatccgagagggaaataatgatgtgctttgcgagatgctggtgtatggccggctgcttgtattctgtgtctaaaaaaatgtggtccggcattgtgcaaattgttgtcatggcggtctgctccttgtttttgtcaagcatatgggtgattatgcctgctcgaacgctgtcgcttctttgtttcaaacttatttgctatgttcttgtccgcgcactcttcataatttcctgaatgcgtgcttccatctcacataccactttgggataagcatatgcaatattctgctgctggccaatatcatactccatattgtatagctgcggatcctttgatacgccggtctcaatgctgacatctgccatgaacggactgccctcgcttggagaaagatatgcccagttaccgcgacgaagcatctttccgcatccgacatcttccaccatcagttcttttctgcccactgggtcttcgccaatcagagcttcatatacatcctggctgtctgccgcagcatcttctgcgaactcataccccaatgcactggcaaaggatgtaaaaaggtccacctggctgacaagcgcctgagaaacccccttatgcacaattccgggacagcttactataaagggaatccgcgtaccgccgtcaaacttgctgtatttcccgccgcgcagcggtccggacggacggtgggttccggtcagttcatatgcacggtccctgtatccgtcatccagcacaggcccgttgtcactggagaaaatgatcatggtttcatccagaattcccagacgctctaactccttcatgaattcaccaacacaccagtccatctcaactatcacatccccgcgtactccaagttttgtagctcccaagaaacgcggtgccggtacacgtggtacatgcggctgatgcagggcataatacaggaagaacggctggtcattctcatgacagtcattcacaaacttacatgcacgattcaggaaggtctcaccaagttcttcatccttccagactgccttttcaccgccccgcatgtagccgattcggccgattccatttatgatactcatatcatgcccctttgaagaatgcatcttcagtagttccggattcttatgacaggttgaaatgtcttcaaatggacattccttagcatacgaaacctcaatcggatcatccggatccaagtttacaaccgagcgcccttccagatatacacatggaacacggtctgctgtcgccgggaaaataaaggattcatcaaatccgcagtctaacggagtataattaatttctttattccagtcaatcggactggagccgtcgcttaatcccagatgccatttgcctatcgcaccggtatggtatccgacccgtttaaatgcttttgctatggtatcagttttcggaccaatgatgcagctggcatcacccggcaggatatgggcctccttgttgcggaacggatagcagccagtcagaatactgtatcgggacggtgtgcagactgcacaggtcgaatacgcattggtaaattttaatccattttcacatagacggtcaatatttggagttgaaatctgatggctgccgtaacagcttaaatcaccgaatcccaagtcatctgcatagacaataactacattacgtggtactttttgactcataatatattccttctcctcttcatttttatgataaacctatagctatatattaaagtcattccccggttccgtctatatatgattacttttgatttatggactaatcgttactagcatgatataatttaatacaaaaatagaaattgtggatttcagatcagaaaagggggactatacctatgtttcaggtggccggacacatctacccagtaggagaaatcgatatgccgcggacagagcggcctctcatggtcactgcctgcggacacatagtcgttgcgaatcaggggataatctctactgcccggccggaagggcgaagagattatcagctcctctatgtccattccggcctggcctattatatgctccatgggaaagagcagaagttatctgcaggacaaatgatcttctatcatcccaatgaaccgcagttctatcactatgacagtgcagatacacccgatgcatactggatccattttaccggaaatgatgttccaagggaactggagaatctgaacctgttttcaaaacgtatttattatccaaaatcccgcgatatctttccccagatatttaatacgatcattcaggagctgcagcaaaaaaagcaatattattatagcatagcagactcccgttttaaggaacttctctgcctgatgtccagagaaattgccgtccatgacgagatgggcgccccacataccagggaaatcgaacaggctgtccgtctgttccacacacattttgatcatcccggcagtctggcagaatatgctgcttcctgtaatatgagtgtctgctggttcacccagctgttcaaacgccagctgggtgtcagtccacagcagtacctgatgaatatccggatctcccgcgcctgcgaactgctggcctccggctccggcgtggcagaggccagcgaagctatcggatatgtggatgctctatattttagccgcatttttaaaaagcatacagggcaaacaccgtcacagtaccgcaaagctgcactgtcccgaatacctgaactgccggatttctagacggtagtatacaatagtttgcgaatttggtaaagaatggctcctttctgctaaaaatgatagctataacacttcttatcaaatcatcactaaccatcatttttcaattttggggttatcgttatcctcccccttccttacatagcaaaaccccggtccaaaatcctcgaaccggggtacccaccaatccagtatgtcggaaattcaaacatactgaattttcctccaactcaccttcctcaaaaatatgctttatatactctgttattgttcttctcttatcaaaaagttttgcaacgcgagggattatatcctttttttaatacaaatcaatggcagaatcgcatctctaacacacgatttttactgctgtttcgtcactttccagtctctatgtcaacaactgattgttcgccgccagaataagctttgcatcaattctagcgtttccctctcagcagccctgtgcggcacatcctggtcggtaccctttcataattataatgtaccgcgatccgctagtacagcgcttcatgcatctatttctccaggcagtggtttaagtacgaggacttgcccattcccggacgggcctgtactttctgataatttactccacccaagcaccgtttctattaaccacatatccatccggtgtcactgtatttactgccatcgctccgttccagcctaaataataccattgatcgccccataatacccagcgggataccgccatacttccatccggattcatgaaataccagattccgttatcgaaaacccaatcggttatcatatatcccgcttcatcaaaacagtaccacaggccgtcaatctgcgcccaggaagaagttatatatccacctgaattcttttgataccaccagccagtgtcgtctttcttccaaattccaggaattgtattggcaggctcccatacgctgctatcgctgttatctgtgaccggtggggttatcctgtcctttctgtttcctatcacaaacagcgataagtccgtgatcaggaagctcatctgatttcccttgactgccggggttatagcgctccattcgccattatgatactggtagatgaccagctgctttttggacataccttccggtatctgcatacgaaggcgaacgggaagcactgactgaatctcttcctcattcgtaatcatggaaatatccactgcaagaagatggtctaattccccggcgatttcagatatcgcttcttctgccgttgttttttcaatatccaggcagagcagttgggattgacccatacttaaatctgcgcttagtataagcccttgcgcattgacattttttaatatgttatctgcatttacagcaaccttaatgtcagggtatgtctctgtcagcatccgatccaggaacagaagctttgaatacatcttatcgcttattcttccgtcttttccatgtgcttccagacactccccggcatcttcaatcgcctggctgaatgcagcctgtttctcactgtctgtcaagtattctctgtattgaagggcctgctccagctctttttgtattgcgtacagggttccggtaatcacggtctccttgtccttgcttaccttaactgaaaagctgtcggaaaataccacttcttccccgtccttgtcctctccgtaataaagaactttcactttccggttccctgttttcgataaatccggtttctccacctccaaagcttccaacggcacccgttcagtgtacgttgcattgctggatgacgccagaaccttaaccgttttttccacaatcatgccttccggatcaaactcttcttccggctcatacgtcagcttgtacggtttttgggtcaccttaatctgctctacaatacggctggattcattgccatcaaacacccggatatcaaagaaatcctttaattctacagccggcacacctcctgactctatgctgcagacaaccgtaaccgtagtcgttcccgcttttgaagtatcatactctaatatataatcgccttccttcagtacagtaaccttctcatccgttaagttaagaccgcgcacttccagcccctccggattgatctcgtctccggttgtatagaccaattgatccggtttttttaccactttgatcgattgattcagcttttcttcataaaccgtaaccgtaaaccacgtctcatattccactggttcgtctgcgctcctgtccgtgtaggttacagaaattttctggattcccggttttgacgtatccagttttcctaccgtatactcaccgtcttccaactgcctttcttccaccccgtctttgtagatgaaaacctccaaaccggtcaaatccaattgctggccaatccagtatttcgtctttgcaggcaatgttttgaccttaagtttccggtcagcctgctcttccgcagcctttaccagctggaaatccacagctcccgcattcttgccgttgatttcaacggtctttacctcttgtttgtatccgtttttggccggcagctcgacgctgtataccccatccagtaaatcccagaagccatatacgccttcttcgtctgttttcactgcattggaaggacttgccgtacttatatcactgcccttatacagttttacggtaacatcccctgcgccttcccctgtttctccggtaacacggccggttatcccgtatgaattcacttcaactgcttcaaaagcctggatttccgaataactcatacgggcgctgtatcctccccagccgcctttgtgtccttttccgtatacacgcagataccttgcagtcaccggctcattaagagagatgatctgaggggtcttccgcaaattaccggatatatccgtgtcactttccatcacaacatctgctttgccgaaaatcgtagtggtagtatcagccgtaaaatccggggttgtactgagctgaaccatacagtccttccaggtaacagacctgaaatccgttaaataccagaagcggttgatttctacctgtttaacagccttttcgcctccaaaatcatattggagatatgccccctcccatttggaatagccgttgtcactgccgccgctttctacaccggcgttgaccgttgtatagacagtcttatcggttgacggcccccatccgatatcggtatcggcgctgccgtcggtagccgcctgcttattgttaccaatcgcggtatttgataccggcgtttttccaagaagcagattctctcccatcggtactgcctcaagagcatcgatggcttcttttaaccttgcgtaagccttttcaatttcgctgccggctgcttccggatcagccagaacctttttcgccgcttccagagcctgggtatacctccaccaactttgcggagtataattaccggcaaaatactcctgcttaataagcccgtttaaatccggcagaaattcaagattctgaattgccgttttcaaattctcataggcttcgataatctctcggtctgctgcatctgttttatccaaaaccgcctgtgcttcccgtttcttcagcaggtaattttgccatgacgcagccttatattccttttcgtgatacacacggtttaccagcttttgcagttcttccctgtcgatccggtaaggcttggcctggatatatacattaagctttgcgttaatgtgatccgtattcgtaacgcctgctggaaggttcaccaattggccttccagagtataaatcgttccttctgcattgccgtcaaatccgctcgtatcccactctacatcaatatccctttgatctgaaagggaagacgcctggtttaacatgaccgccacagaggtgtccagcctggcctctaattcgtcctgagtggttccataaggaactaccagatttccctcctttgtattaacttcttttatgttaccggttgccgtaacattattgctgcgccacacacgaacgtaatccacatcgaaaaccgtatgaaaatcttccatatttccatcccggtatggggggcgcagtcccaatgataacaacagattctggggaattgcatccatattggaagcatgcgtggtagatacctgctgccagacggtatctgactgtaccggtccggcggagcctgaataaaaacgaccttttaattttccatctacatagaaattctgatagccaggcccccattcaagaccgtacgtatggtattcacgggaaggattaaagggattttggcttccccatattcctgcgctcccatggggattcttatcctgttccggaacttgtactgacgatggcgtcttgaacgtatgaattgcaaaatcaagctcatttacggtctgtgtctgcccgatttccagcacgtcaatctctgttccccaattttcggttcttcccaaaagccagatagcgctgcaggcgccaggtaatgcaggcgcaccttttgcacgggtttccatgtatccgtatttcatggattgtctgcttataatgccgccggacgagtaattcatatccgtaacatcttcaaatcccggattaggggctaaattggtagtaccgccctcttcttggaagttgacatcatcaataattgtcattgcatagggatcggcttttacttcaaatccgattttacacattcccccactgccaggagtgatgcctgatagggtataggcgacaaagtcgtcattttcagcaaaatccatagttttcccccctataggtattgctttatctgaaggatcgaccgcatacatctttgagactggctgattacctgttttcttcacatatgccgtaaaggaatacgttttatccgggtctagatttcggataacggtatccgttctgacccatatcggaaagaaattaccatatacaagcgcagacttcccggatctcgatccgtaaagtgacgtcacatattcaccgtttacagagtcgccgtcatacatgttgtgactgttccagccattgggtgattcgtctatgagatcattttcatcatgtcttgccataagatgtagcttgccatcgctaagactgacattgtcatcctgccagcgccaggccccagcccaggtatacggtatgggttgccatttctctgtgtcaagctgtggttcattgaattcatcggaaagagcctcatccaaaatccaattttttgtattggccggatcagagccaggcaataccgtattggtcggctctgtcacagatcgttcctgcgactgttgaaaatctgtgttagacctcgccaccccttccggcggctgggccagagttgtcgtactgattattgcaataccggttaatacactaatcgcagaagcaaaaattcttttcatatataattccccctatcttataattgaacggctccgtaaattccatactttcaggtattctgctctttaattactgtttttcattacacctcaccatttctgcatatttcagttaattctttacctaatgctctacactcttagctttcatcgtttcacttcctttcacattgtataatctgaattttgggtaacatttcatacgcaacagttatatccacaggcatcaaccatgaggtttactttttaataatggcactaaacgaccgcaattacgggcatatccatcttttatagaacaaaatccagagtataagaaccctggatttataaatttattctattatacaatacatcagaaactatagaaaactccattttttttgtaaaccggtgtatatttttactctattttctcttttcaaaacgattagttacaagaagcagcttttaagtgatgaattttggcataattttcttttgggatttcctaccatttttcatccaataatatttcttggttcattagttcatccccgtaaaatgtctgcaccacgttctcaatggagaactctatttcgggatccagcccttccaattataaaatccctattggtgttcactgccctataaatctggtaatctgaggctaatacagactgtatatgccattgtcctgcaaatatattccacaacctattctctggaaaaatccaccacatactggtttcttcccagagactgtaagaggcccggcacatgtaaaatccagtccggacgcgtcgggtataaatcgctgttcttatttaccatttccggcccaaaccataatccaaagcgaagtccccgctccttcaaccttctttgccagttcgccaattccattgagtatctcatattctgatcgcgatccccccatagcaaaaccccggtccaaaatcctcgaaccggggtatgtcatccacactttgccattttcagccccataaaacgcagccggaaattccatgatttcagcccatttccaggtccaaaaccaccacatattgtggttatatgcacttttttatccaaataccacaagtgtcatccatatcactgattacactcgtcaatcgccttcccaatatcatccctcatatacttattcccaaattcaatccactctgtcgcccgatacgcattctcccgcgccagctttagattctccccctttgccgtcacgcccagcacacgtccgccgttggtcacgattctgccttcgtcgtcgaacttcgttccggcgtggaacacgtagtatccgtcatgatccttaaaattctcaaatccgctgatcggatatcctttttcgtagtgctccggatacccgtcggaagccagcacaacgcagaccgccgcgttatcctcaaactccagttgaatctgatccagcgtgccgtccacacaggcctcaaacacttccacgatatcattcttcatacgaggcagtacaacctgagtctccggatccccgaatctcgcattgtattccaggacctttggccccttctctgtaagcatcagaccgaagaaaatgattcccttaaacggtcttccctcggctttcatcgcgtccacagtggcctgatacacgtatttccggcagaattcatccacctcttccgtatagaaggggctcggggaaaaggttcccatgccgcccgtattaagcccctggtcaccattcttcgcccgcttgtggtcctgagccgaagtcatgatcctgattgtatctccatccacaaaagacagcacggatacttcgcggccggtcataaactcctccaccacgatccggtcaccagcggagccgaactgcttatccagcatcagcgtcttgacgccgtccttcgcctcttcccttgtattgcagattaaaacaccttttccgagagcgaggccatccgctttcaatacgatgggcatttcggccgtttccagatacagaagcgccgcctccggggtatcaaaggtctcatagcctgccgtcggaatcttatatttcttcatcagatccttggaaaatgccttagagccttccagaatcgccgcattctttctcggtccaaatacgcggagtccttccttctcaaatacatccacgatgccgcccaccagcggatcatccataccaatcacagttaagtccacctggtgttccttcgcaaacgctgccattttgtcgaactccatggcgccgatcggcacgcattctgcaaattcagcgattcccgcattgcccggagcacagtaaatcttatccaccttcgcgctctttgccaccttccacgcgatcgcgtgctctcttccgccgcttcctacaatcagtaccttcatcatccgcctcctgatattctaataagtaagtctgcttttacaaaatttaaatttcatccaaaacgccccatccttgatatggcggtccagaagcatgctcttatccggaccaccacatctggtggggaatattaattccaatcctgtcaattgtttggctggccgtctgcaatcagctggatggcctgcggcagaataacccattccgcctcttccatcacacgccgctgcaaaacctccggcgtatccccatccttcacctctacagccttctgtaaaaggatggggccgctgtccacgccttcgtccacgtaatgtaccgttgctccggtaacctttacgccccgctttaacgccgcctcgtgaacctttaagccgtaatagcccacgccgcagaaagaggggatcagagatggatgaatgttaatgatacggttcttatatttcctggtcatagcctccggaatcgttacgaggaaaccggccagcacgatcagatccagcttgtattcatctacctttgccagaaatgcctcattaaacgcctctctggtttcaaactccttcggagaaatggcaacagccctgattccatgattcctcgcccgttccagcgcatacgcgttgcggttgttgctgattaccacttccacgcttacattggtgagatggccgtcgtccatcctgtctaagatggcctgaagattcgttccgccgccggatacgagaatgccgactctcagcataaggtcactcccttttctcctgcctccgtataaccgattacatacggaatctcgccagcctcacggatggccttcatggctgtatcaacgttagaaggatcgaccgccagaaccatgccgatacccatgttataggtattgtacatcatctcctcttcaataccgcccttctcagccagaagcttaaagatcgccggtacctcgtagctgtcctttttgatgactgctctgacaccgtccggaagcatacgcggaatgttctcatagaagccgccgcccgtcacgtggctgcatgccttgatcgtaacgccgctgtcctttacgctctttaaggctttcacataaatcttggtcggagcgatcagtgtctcacctaaagttccgcccagttcatcgtaatacgtatcaaggctctcctttgtcatctcaaataccttacgtacgagagagaagccattgctgtgcacaccagaagaagccatgccgattaacacatcaccggcttttaagtctttccctgtgatcaggttcttttcatcgacaacaccgaccgcgaaaccggccagatcatactcgtcctccggatagaagcccggcatctcggccgtctcaccgccgattaaggccgcgccggcctgtttgcagccgtccgctacgccgccgacgatctcagcaatcttttccggaaaattctttccgcaggcaatgtaatccagaaagaataaaggttctccgcctgcgcaggcaatgtcgttgacacacatggcaacacagtcaatgcccacggtattgtgcttatccataagaaatgcaagcttcagcttcgtacctacgccatcggtgccggaaaccagagtcggtttctccatatccttaaatgcactcatggaaaatgctcccgaaaagccgccgattccgcctaacacctccggtctcatggttcccttcacgtgttccttcatcaactctactgacttatatccagcctcaatatccacaccggcattcttgtaatccatttctcttcctcctcgctatgagcacttggcgcctgtatttcaggcgcttacgtgcgatgcatgtcatctccacttagtgactctgtcttatttcttcatctgtgcaagatattccttatatccgatctgctccagcttgtccgctttcttcaccacatcgttctttaaattctcagaatactcctttaatctgccgagcagagcttcgtcagacgtagaaagaatcttagccgcaagaattcccgcgtttgttcctccgttaatcgcaactgtggctaccggaataccggatggcatctgtacgatggaatagagggaatccacaccgccgagatcggaagtcttcatcggaattccgataaccggcatcgggaaaagtgctgcgcacatgcccggaagatgagccgccttgccggctcccgcgatgatcaccttcactcctcttgcctctgctgtcttcgcgtaatcaaagaatatatcaggctctctgtgagccgaaataaccgtaatctcaaaatcaacacccagtttctcaagaacgtccgcggcctgcgccataacaggcatatcggaatcactacccataacaattgctgcctttgccatagtaaatctcctttcattattaacggttatgtttctcattagttatattaatatataaagcttacaaatcagtctttacttataattataatactagctttttatgttcccgtcaataattttcttgaaaatcctcatatataaaataatgtaaaacttcctttacaaaaattgtaaaatgcactttacttttaatgtaaagcgtgctatactcaaaatgtaaagggaacattacttttaaaaaagaaaaggaagtgttgtgtaagtgaaaacaagaatacaggagttgagaaagcaatcgcgaatcacgcaggaagaactggcggatgctctgggcgtaacgagacagaccatcatctccctggaaaacggcaagtataatgcctctctccagctggcccacaaaattgcagtatattttcacatgaacattgaagaaatattcttattcgaggaggaataaactatgttgctgaacaatttatttattgataatccaatcaattttgagaagagatgcaagaccagaatcatcgccagctgccttcttctggtgctgggcgcagtcacgatcgccctctccttcctggcaggcgaccatattcctgtgctgtacatgaccgccgaccactatgacttcatcccgggcttctatatgggaaccggattcggactgcttttcgccgccatcgcgacgatcatcaaaaatgtccgttatttaaagaaaccagacttaaagaaagaacgggaaatatatgagacggacgagaggaaccgtatgctggggctgcgcagctgggcttacgccggttacgccatgctgttcatactttacatcggaatcctggtcagtggtttcatcagtatcattatacttaagacactcctggtaatactggctgtctatgtactggtcctgtttatctttcgaatgatactgcagaaaacaatgtaaggatttataacagcctggtaaaaggcagcggtatctgatcagaatcacggattaaattaaaaaacacagaatacaccgtcgggtctgacccttcggcatattctgtgtttttatttaagctctaaatttataacgcaaatttatctcccattttctgcatttctttgagtccaggccccaggcccggcaatttgttccacgttcagtccagcggaacattcagctcctccactcccggaagtacgaatcttccgtcggcgataattgaaatcctgctgccgtccgcccgcaccgcgtcgatcgtatccagctccgaataaggaatcgtaatatccgtatggcagctgaaatacgccttcgacaaatcttccttcctcaaaatggagatctcgttgtctctggctataatttccttgccgttcggattatacacggcgctgtcctcggcccagctgtagcacgtatcgccgaccgcgaaatgcggtcccatcttctccacgatcagaattggaagcttgtcgagaattccgtatttcccggccatggcgtacgccgtcgtattcgttccgatggcgaactctcccatgggaagcgtgtcgtggttcttcagaatcatctgttttaccagcgccttcccctcttccggattctcaaaattatcgcaggcataccctctgatcatcccatcttcaaacgtcatagagagattcttaaactggaaatccccgatatacaccgttccgacaaacagagtcccctccgttttggacagcttcggcgacgtgaacacctcgcccagcggaatgttgacatccgccacgcagttctcaaaattcgtctccttttccctgtctccgagttcatgcaggcttacgcgcaggtcagtccggttgtctccttttcccttcacctccacgtaatccgcctcatccagcgcatcgatgatcgtctgctggatcgtcttatacttttcataatccagcgtattgatcgcaatggtctcctcgaatatcttctcgaaacgttctcttgcctgctcggggcttaagtcgctgcggctgtcgcgtccgatctccggaaccggaaatgcgatgatcgtaaagctggtctcatcacccggcatatattcgttggtaatcacagccgtctcattggctgccctggcgctcagcttttcctgttttgcgtccaggcggttggcctccggcttattgaccggctggaagccctcctgtccgaaggtctcgatcacagcaggacccgcgtaggctgcggcttctttcttatactgctcataggccacccgcagaacggaagccttcctgtcggtaaacgccttgtttaagtagatagcctcgtcgtagcggtgatcgtactcatactggcggttggccggcctgccgtaatagcccacctttttgcccgccttctgatttacagaccacaccgcagagcggcaaaggatcgtatccagccccatctcacggaagttctgaatcgccgccttcaccatacgctcaaagcccagctcataacggatctgcaccgcactcttctttgacagatcgcgccccatcacctcgaagcccttccggtacccttccgtataggtgtccgccataagccgcaccgtctcctccggaagtgaattcataaactgcgccactaacagctcggattcggatatataatcgccaaaccggtataaataccgcaggtcgcttaaatcgctgtccaggatgatgtccttcgcaaaagtcagcgtgggatccacgccttcccggatgcggtatgccaccgtatagtcacagtaatcgctgacaaaccagtagagcacatccttaatactggcggcggaagggaccgtatcctcaaacatattataaatctcaatcagtgtttcatttaaaatggtgatatccgtcagcctgttttccgcagcaaagataatatcgccccggatttccttataaaggtaagaaagcagctgtccatactcttctcccagagcggaaacagcgtactgcggattgccatagctggtctcgtaattctccggaagaatgtcctcataaagcctgtggttccagtcctctaactccttaagcggcgcgttttccgccagtccgcctgccaccatttcccgataatcgccgatcatgccgataaaggatgccatcttacggaaataggagcggtacggttcttccaccgtctcctcgctctggatggcctggagccgttccatggaaagctgataccgttccatcacactttcattttcttctttgaatctgtcacaaacgttcattgtcatcctccaaatccaatgataatcagaactgcccatacaataaccagaaagccgctgacggccatccctattttggacagtatgtacttcttttccttttcaaaaaaagaaagcgccccataaatcagagagactatggcaatcaggaagctgcagaagcacaccgcggccacattaagctccgcgttccctgccgtcatgaccgagctcgccacaccgatgaccgcaagaatcaaagcggcgacagcaagcccaagggccatgaagcttctcctcgcaaatggtttcctaatgtaggatacttttttctgctgctgcacgccgcttcctcctcactcttatcgtctgtacaattttgtagaacacaaagccgagtaaaccgccaagggtgttgagtatcatatcgtctacgtcgaagctgccgaccttccacaccagctgcaccgtctcgatgcagaggctgaacagaaagcttaacagcacggtgttataccagtgacggcttctgcggctgataaccggaagaaaaaatccgaatggcataaatccaacaacatttcccacaatattcagcaaaaacgaccggattcctaccacgtgccagtacacaataaagcgtctgatctccttgaacggcaccagattataggcgtactcctcctgcagatggcttccccggccaaagtcctcggagaagaacaggaagtacgccaaaaaaatcaggtaaacgataaaaatcacccaacccagcttttgtcgttttgttgtattttttatcataaatgccccatttaaaaagtgatctcggattttctcttaagcagaacagcgccattgatgatagacatgattccaacgcttaagcctgctactgtaataatgattccgattacaatgttaagcgcgcccgcatttctcatggtcttataaactctctccatattcagctctccttactttacgccgtagatttcataataggcgtcaattgccgcctttaaagtatcatcaataataatctttccgttatattccttattatacagatattcgattacttctgccatagtaacgatggcttttgcgttgaaaccatacttgtcatgaatctcgtcaagagcgctcttctctccttttcccttctccatacggtttaaggaaaccatcaggccaagaattgtcacatcaccctgtgccttgataattggaaatgtctcttcaatcgatttgccggatgtggttacgtcctcgatgatcaccacgcggtcgccgtccttaatcgggcttcccagaagaatccctgcgtctccgtggtcctttgcttccttccggttcgaacagtatcggatctctttcccgtataattcatggtaagcgatggtggtcgccacacttaacggaattcccttgtacgccggtccgaacagcacatcgaaatcatccccgaaattatcatggatcgctttcgcataatactcacccagcttctttaactgcgcgcctgtcacataggcgcccgcattcataaaaaatggagactttcttccgctctttaaggtaaaatctccaaacttcagcacgctgctgtctaccataaactctataaattcctgcttatactgctccatcttatcgtccttcctttcgccggcctcttaccgtacggctccgactaaatcattgatatcttctacgttatatttcttcatatagctttcgattccactcacaacctcggctgtggcatacggattatggaagttggccgttcccacagaaactgccgtggctcccgccaggataaattccagcgcatcctccgcgttcatgatgccgcccatgccgatgatggggatctttacggcatttgccgcctgatacaccatgcggaccgccaccggcttcacagccggaccggataatccgcccgtcttattcgccaccgcgaaggttctgcggtttatatcaatcttcatgcctgtcagcgtattgatcaaagagagcacatcggcgccgcccgcctccgccgccttcgccatgacggtgatatccgtcacgttggggctcagcttcatgatgaccggctgcttcgcatgcttctttacctctctggtaatggcctccaccgctttcggatcctgtccgaaggcaatgccgccctcctttacattgggacacgaaatgttgatctccagcatatccaccggttcatccccgagccgttctaccacttccacatagtcctccgtggttctgccgcagacattgacgataatcttcgtatcatactgctttaaaaatggaatatcgcgctttgcaaacacatcgattcccggattctgcaggccgatggcattgatcatgccgccgtacgtctctgcgatcctgggagtcggattgccgggccacggcacattggccacgcccttggtcactactgcgcccagaccgtttaaatccaccatctcgccgtattccgctccggacccgaaggtaccggaagccgtcatgaccggatttttcagctccacaccggctaagtttactttcatattcatcagagttctacctcctctgcccgaaataccggcccgtctttacagattctcgcattgtgaacctgggagtgttcatccacgttctttgtcttgcatacgcaggccagacatgcgccgattccgcaggccatcttctcctcgagagacagaaagcaggtgatgctctcctcggcggcataggcctttaacgcgcgcagcatcggagtcggaccgcaggcaaagattacgtccgcctttaaaccgtgctctctgatggcatcaatgacattgccctttgttccggcgcttccgtcctctgtcgcaagaaccacttccccgtaaggggcgaattcctcatttaaaaacaggacatcacgatatcctaaaatcacttcttttttgcagtgtaactgcttcgccagctccagcatgggaggaatcccgattccgccgccgattaagaaggcggtctttccctctgctgcttcctccagcgggaatccgttgccgagaggtcccatgatatcgaccgtatctcccgcctggtaacgggagaactcctccgttcccgctccgacggtcctgtagacgatccgcagcataccggtttctttattcgtctcacagatgctgatcgggcgcggaagcagttttgctccgtcctttgtatacacagaaataaactgtcccggctttgccttggcagccatctcctcctcccggatccacatgctgtatacatcttctgtcagcctttcctgactatccacaaaggctgttacttttctctgcgccatgattcctcctacagtacgctgttgatatcggaaaccatgtcgatcacggcctgtctggacgcttcaccgaaatgctccgcgccaaactttgcgtatttctcctgcttgtaggcggcgatgatgcctctggaggagttgacgatggcgccgagtccgtcttcattgaaacagtactttaagtcctcggcggtgccgccctgcgcaccgtatcccggtaccaggaagtaggtattcggcatcagtttccttaagattctgctcatctccgggtaggtcgcacccactacggctccgacgttgctgtaagcgccatccatgcagtctgctccccattccactaccttgtctgctaccagctcgtacaacggtctgccgccgatcagctgatcctggaattcaccactggaagggttggaggtctttaccagcacgaagaggcctctgtcctcctccctgcagacatcgacaaacggttttaccccgtcggtgccaagatatggattcacagtcaggaaatcggtaccgaaaccggtaagcacgctgctccccaccttcacatggccgatatgcgctgtggcatacgccgcggaggtggaaccgatatcccctctcttcgcatcgccgatcacgagaagtcccttctcctgacagtagccgacggttctcttgtatattttaagtccttcgatcccaaactgctcatacatggcgatctgcggctttacagatggaataatgtcatagacatggtccacgatttctttattaaactgccagatggcctccgctgcgccttccagtgtctcaccaaactcatcaaatgcctttcttgtcacatgctccggtatatagccaagcatcggatccagtccaacacagatgggtgcctttgttttttgaatcctctgaatcaactgattaatcatagtctcctccttcgttcctcacattttctctattcttaccaattctatcataagtaaggggctgtttcaagcgtctttctcgccgtacatccggtctatatccagtaataaaagaaatcgcgggaaaaattagcactcacctattgacagtgctaacaatttgtgttatattacacctagaacaaatcaaacaataacaccgcatcaaaagcggtgcagataaataaggaggaagaacctatgttattatccagaagaaacaacttattcgatgaatttttcaacgatccattttttaacgactctgttcagaacagaacaacgcttatgagaaccgatattgaagatgacggaaccaattacatcatcgacgtggaacttccgggatacaaaaaggagaatgtgcgtgccgagttaaaggacggctatctgaccatctttgccgaggcgtcaggctcttccgaagacagcgagggcaggaacttcctccgcaaagagcgctacagcggctcctgcaagagaagcttctacgttggatcccagttacgccaggaagacataaaggctgctttcgacaacggcatcctgaagctgaccgttccgaaggaagctccaaagcagattgaagaaaaccactacatcaccattgaataacacatatccccgcagccccctttagaatagaaaatgaggacagccccccggagcgatccgtctgccgttttataacggcagcgatttccgaaggggctgtcccttttttatcttgatgtctcgattttcttctattatccattctctgtatccatgcctgaaacacagtccggcattattccagcagaaatgcagttgccacgtaggcgccgctcttataagacttctttaccatctgcgcttccacttcgatctttaaattcagccacagctcctccgccgcgatggacagatgagacagcatgattcccatgctcaaatccctcatcgccaccatggtctgggacgggagaaattccttgcaggaaaaaatatagattctgtcatggtagacgataaaacgccagggctgcgtattcatggccgaaggtgccagacggacggctttcaggatattcttcaccggctcgccgatctcatccttaaacacgcagagttcttttaacggcagacgctttgccgtagccggatcgcggtacagcagggatttggggtatccaaacgcaacggctatggccgccttcatcccggccggttccgctccggggatgcgggtgctgccgaggtagcacgttcccaggccttttccggtcatatagaggaggaccggctccagaacatatccggcattcatcatatagccttccttatcttccgaataaaacaccaggtaatacggcgcttccaccttccacaagcccttgacgtgaaggtctttctctatattctccttaatctccatctttatagaaatctccgggcagagcgtcgccacgcagcctgcaaaggccagaatatcctttaacagctgctccggtaccgcttcatatttaaattttcgaatggatcttctcttgaagatcatctgatacagattcatccctgctcccctcttttcgctacagcgtcttatattcctccagcagttccttaaatacggccagagcctccctgatcggctgggctgtggacatatccacgccgcacagctttaaaagttcgatcggaggcatggaattgccgccgcttaagaacttgaaatagccttccagggcctgttcatcaccggccaggatcctgctgctgatcgccatggccgccgagaagcccgtcgcatactgatatacgtaaaatggcgtatagaaatgagggattctcgcccactcataatcgatctcgctgtcgaccaccatctccggtccgaagtattttacattcagctcatggtacagcctgcagagcagctccgccgtgagcggttctcccgcctcgcttctcctgtgggtctcggcctcaaactccgcaaacatggtctgacggaacaccgttccccggaaactctccataaaatggttcagaagatacgcccgctccttcttatcctccgtcacggccagcagataacggttcagcagcgcctcattgcacgtggacgccacttccgcgacgaaaatcttgtatcccgcatctacgtaaggcagcgcctgatcggaaaaccaggagtgcagggaatgccccatctcatgggccagggtaaacacactgtccagagtgccgctgtaattgagcagcacatacgggtgggttccgtagacgccccaggagtacgcgccgctgcgttttccttcattctcatagacatcgatccagcggttgtcaaagccttcctgtaaaagggacagatacttctctcccagcggagccaggccctttttcaccatctccctcgcctcttcatagggaatccggctgtcgtcacggctgaccatgggcgtatacaaatcgtacatgtggatctcatccagccccagcacgttctttctgacggcgacgtaatcatggagcagcggtaagccttcctgaatcgccgccaccagattgtcgtagacgctctcaggcacctcgttctccgccagataataggcgcggctggaggcgtaatttctggtcttcgcatagaaggaggcctgctttacgtttgccgtgaacgtcgcagccagcgtattggcgaactggccgtagacgctgtacatggactgaaatgcttcttttctcacacggcggtcccggttctccatgagcggaatatacgttccgtgggtgacgggaatctcctttccctcactgtctgtgatggacggaaatttcacatccgcgttattaaacatgttaaaaatatcggaagggctctgggtcgcttccatggaccttgccagaagctcttccattcctgcagaaagcgtgtgcgccttcttcttcatgatgatttcaaatgtccgggcataccggcagagctccttctccgtgcggatcaatccgttcagcacagactcatccatggccagaatctccggaaaaatataagacgaaagtcctgctgccttataggagagcgcctgggctcttgccgaaaaatcctgatacttcgcctttgccgtatcctcatcggatttctctcttccgtatacaaacagcctctcaatcttcagtgaaatgtcttcatcgaatttcaaacactgaaacagcacctcgccggattcggccagatgtccttcaaactccttataaccggccagttctctctcagtctcgagaaacagcgcttcccaagcttcatcagacggcagaatgtccgccaggttccaggtatcacaaaccggtatctcatctctctttttcaaaataatccctccactatatccactggttttattctatcacccatatttcaaagaaacaatcagcaatatggaaaatatttgattgaaatcacatggtttcttgtactatactgtatacaccagtactgcgcagtgcagtgctgatatttcctccggaaaagaaaagggagaacaccatgaaaatcatacgcacaaaacaattagacctccatcagctggaagacttgcatgccctcgaaaccgcatgccggccgcacgatcagacttcactcacctttcccacggaagacggctgtcttttctttctattatacgacgaagaaacgctcttatccgcattttctgcaatttttaacgaatttgagacatgcagctgcagcgccttcacgctcccgtcctgccggagacgcgggcattttacccggctgctggaagaattgctgaaggagtcgggcgaatgcgatctcctcttcctggccgatgattcctgcgccgacgcgaagcatacgctggacgctatcggggcggagctattaaaccgggaacacatgatggagctgcgcctgcccgcgccgtctcccggcctggacagccgggcggtcaaattctcccccgcactcagcccccggaatgaggacacgctctataccatccacgttaatgatcagcctgccggctccttccacctcatttttcaaaatgaaaccgtttacttctatggtttcgagattcaggaacccctgcggaatcagggaatcggaacccgtgccgccgccgcgctcattgaagaattaaaccggtcagccaggccgcagccggaggaccttccggtcagccgcgtcctgcttcaggtatccggggacaacgaaccggcgcttgcactttatcggaaactgggctttgcttttacagagaccctgtcgtattacgtgtattaacggattggagcagcgataaacgggagccggcgcaggacagatgtctgttcctgcaccggctcccgccagcttctctatacttcacgtatcatacaatactgcttcaaatcaaaatgcttctccaccaccccgaacaccttaaatccaaagtgctggtaaaacgccacattcttttcattgtgcgtctccagtgagatcatctgcctgtggcggtccgcgtaatcgatcgcctcatttaaaagcagggccgagattccgtggtgctgcatcctgggcctcacggccagataaatgatatgtaaccgctcctcctggtggagctggtccgtccatttggaatttaaatagtcccgtcccatggcaaaattccagaacgtcttcagtgatgggtcttccttgatcagatacccgtctgtccgcagcgtcgcagccgcctctgtcagatagtaatgcaccggattatagggctccgattcgtcatccaccacaatgattccattaatttccgggctgtccgcgtagatttcacacgtctcaaagaattcctccatatcgcattcaaacagctccggcatcagccgtttcctcgtgtcttcatcagggatcagcttgcagtacagagggtccctggcaaaacatgctgtcagcagctccttaagcttctccacatcttctcttttcactcggtacaatcggtcactttccatgattcgttctctgttatctcctttaatttctgtatcattttttctattgcgtggttcatatattcaatatcgtccaaatagcaggccagctggttctcctccacccgcttaaggatcagaagctcttccgtaaaatcctcatcctcttcctccagcttgccctttagaagctgcaccagatgaaacagattttcgtggtggacgatccggccggctccccactgcagacgccccgcctcctgattcatcacgtaatctgtaaaatggcggaacacctcctcgtcaaactgaaatgcataccggttattgtcgatcccgtagatggcctccagcgcacaccgcccatggccgttttccaggcattctacagcggtccgcaccagctttaaatttctccgcacagcttcctgcggaaaacagacctcgtcgtgccagtccagccttacaaagctgtcctgctccattttaaagagctgcatcaggacggcttccagctcacggtactgttcccggtctttccagggctgctcctgattccggcacttctcattaatccggcgcacctgcttataaaccgcatttcccagccgggccgcctcttccgtcagctccttcagccgttctccgccggctccggtcttctccgaatagtcgagatccaggctgtccttaagcgccagaaacagcctctcaaaattaaggggcgctaccgccgtccggtcgaatgccatgaccagacatccatacagctcatgatgaaaccggtataccgcctcgtcgtaatagtcgtcattgtcaaactgcgtatggtagtgggtctccatgaactggcccgacgtgaaatcgttgaccatggatggaatgcccgagatcgccatggagaaatcgtccgacatggtctcgacgggacagagcacagccacgccttccggatacacgtcctttcccacaccggtgcccccgagcagggactccagaaaatccgcatactcgtacaccgtgcgtatggcgtctttttttccgtgtgcgtgagccggcagttcgaaattaaaatctgccgccacctttccccgccattccggatggacgacggaaacctgctgccacgcgccggttgaccagtcgtatttcgaatccgccatcccccactcctcagccgccatggcgcagaagacaatggttttttccgggcggtatccgctctgtatgagagccctgccgattcccagcatcagggccaccgccgcgttgtcatcctgaaaacccgaaaaataggagtcgtaatgggccgacagcagaatcatggattcccggtcccgtcccggtatctcccccacaatgttgtaggagaccgcccccgtcttaaccgtcgaatccgcgcagaaccagaccttcttttcgtccgtaccggccatgctttccttcagtgcgcgcgcatccgcccgcgacatggaaaatgcaggcgcatcggccgggcctccgatatcctgggcatttaaggcggtatcatccacctccccgtagccgccgccctgaacggcgattaaggccgccgcgccccggatatgggcctcatacacgggaaaattaatccaccactcctccctctggttgatctctgccaaaaccagcttgccggagacatcggcaccctcgtaatccgccgccgtccccttaccgccgcagacgatggtgaactcctcgaatccatcggtgtgaaaatccgtctgatacgcccccagctgacactccttcagctgaccggaggcgtcgtaaaatcttaagatggcctgtttaaactcccaggaatccagtgagatttcatcctttctcacgcgttccagcccgatggcctccatctcccgccggatcatctccccggtctcccattccgccctggaaccggccgtccggtatcccagcgcctcgttgcacttatactgctccatccgctttgccagatggaaggagtaatccacgtcaacggcccttatgtatgcctcttcttccttcaattcgcattcgccctcttctttatgcaaaaagccggctcagaaagtattattttcttaagccggcttctcatttcattattattcttcccagttgtgataggtggcctgaacgtcgtcatcctcgtccagaagatcgagagtccggttcatctttttgatcgcgtcctcatcggtcagttctacccaggtctgcgggatcatggttacgtcggcctctgccatcggaattccggccgcttccagcgcttcacgcaccgcgctgaaatcttccggcgccgtgattacctcgtagctgtcttcctcctcggagaaatcctcggctcccgcatccagagccatcatcatcagttcatccgggtccatctcacactcttccttgtcaatgatgatctggccctttttatcgaacatataagatacacagcctggcgttcctacgtttccgccgcccttggtaaaggcgcttctcacattggctgccgtcctgtttttgttgtcggttaaggtgtcaacaataatcgctaccccgttcggaccatatccttcatatgtaatggtctcataattcacagcattagcgtcgccggccgccttcttgattccacggtcaatcgtatcgttcggcatattgttggctttggcttttgcaatgacatcgcgcagcttgctgttattcgcagggtccggtccgccttctttcactgccactgcaatttctcttccgattacagtgaaaactttgccttttgcagcatcatttctctcttttttgtgtttgatatttgcgaactttgaatgtcctgacattgttataacactccttttcctttatcttcttcgtcctgaaaatattctaaaaatcagcatcttttccattttaacaccattctgttaatctggcaaggaattttcgctctccaccgggctttccccgccattttccggccctgacggggtatccggcggaggcgcaagcctctgtacgcggatggtatgaatcatcttgttctccacctggagaatcttgaatccgtatccctcgtattccacctctgtctgctcgccttcctgcggaatgcggtccagcctcgagatgaggaacccgttgatggtgtcataggagtcgtaatcgtcctcctcaaattcgatatccagggtcttggccacctcgtctaacggtgtcatgccgctgacaatataggagccgtcctccgactcggcaataaattcttcatccacgtcgtattcatccatgatgctgccgacgatctcttccagaatgtcctccatggtgacgataccggccgtctgcccgtattcatcgaccacgataaccatgtgaatcttctgggactgcatctccttaaagagagaatcgatgtttctcgtctccggaatgaaatgggcctcccgcagaagtccctcgatctcacagatcggaaccgacgcattaccgccgttctccgcggcaatgagcgcatctttcatatggaggatgccggtaatgtcgtcaatatccttttcgtaaaccgggtacctggaattatagccttccttcaggatgaaattcaccgcctcctttaaggtcatggaaccgtccagggcaaccaggttcttccggtgcgtcatgatgtcgccggcgtccttgtcgtccagttcgaaaatattggtgatcatctccgcctctctggcctctaagacgccctgctcgtggccttcattgaccatggacatgatgtcttcttctgtcacattttcattgtccgacatcatatcgatcccgatcagcttcagaaacagaaatgccacagcattgatgagccaggtaaacggcattaggggaaccatgaaaaaggtgacgaccggaagcatgttatagccccatttctccgggttctgggccgcacagcgtttcggaatcacgatgccgaagctgataagcagcacaatcaggagaatgcctacgatcagaaggcttaagatggaaagccagggagcggacatgctggcccggcggtccagaataagggtaaggcggccgcccagctgctctaaaataaaggcaccggtgattatgcctatgatattggtagatacctgtatcgtgtttacaaaccgggtaggcctgttaacgatatgtagcagctttcttgccttgtcactgccttcttccatctgatgctctaagtcattcgtgttgacgttttgaattgcagcgccaaatccgtagaatatggcgtctaacaggatgaatagtaaaaatattgccacgctgggaagcgggttgccatcgtccattgtcttgttttactcctttaattgattgtcattggttgttgtttttgggggaccagtacagctttgcactagtgcctcccggcgtaaatacgccttgtatagtgcctgatatctgcgtcaggtgtgcgtctgcgaagcgacggcgtagtggggcctacggctagcttcgcaggcgtgcaactggcgtagagagcaggtgctgtgcatggcgtatttacgccgggaggcgctaggtgttgggtgttctttatccctgctcatagctatgaaagatgataccctcctccccctcatttgtcaagtatttacgcttccttcacaggataaactgtaaacttgcagaattatgaaaggctgctttcgtaaattacttcccggccgaaaccatgagctgaaactgtgggaagtgctccggccccggctccctggcggaacgaaaatcccgaaatttctctcagccttatgaggaaccacaattcttaataattctgcaggtttacaagtttatcctgtctctttcgtattcctgaactatgtatccagttccaaactgatttttaacgcatagtccactttctcctgaagttcctcatcgatatgacaaatcttctctttcagtctttgcttgtctatggtccttaattgctctaacaggattacggaatcttttatcatatcgcatcttctggtatcgagttcgacatgagtgggaagctttgccttgttcatccgggacgtgattgctgcgcagatgacggtggggctgtgcttgtttccgatgtcgttctgtatgatgaggaccggccggattcctccctgctcggagcctactaccggtcttaggtctgcataaaaaatgtctccacgtctgattatcactttctcacactccgtcaattgatttacgtctattattgaccttttttgactcgtgtattcacttaagttattcgctcaagttcttttgccgcatattctatgatatgatacggacatggatgacgttattcgtcccttcacttccttttcggattactttccgaatccttcgtaaatatcatcaaaataatctttttttccgaccacttttcccgcttctatgtagactcttgggacacgcttgccgatgtcgcagagaatttcgtaatggaatccgccgccgatgcgcgccaactcctctactgtaatctcttcctctccgtcttttccgatcagagtgacctcgtcgccctcctccgcctcagggatatccgtcgtatctaccatcagctgatccatacagacacggcccaggattctggcgcggcggccgcggatcaggacatccgcctggcctgacaacgcccggggataaccgtccccgtaccctaccgggatagtcgcaatggaggtctctctctctgccgtaaaggtgccgccgtagctgaccggagttcccggcgcaatcgtcttcaaataggttatggtgctctttaactccatggccggtatcagacgaaccggctccttctccacctcatccgacggatagaggccgtaaatggagattcccgcgcggaccgcgttaaagttcgccttcggaagctctaaaattcccgcactgttggaacaatgcagaaccggaatcgtaacgccccgctcagaaagcatggaaacgaacgtggtaaacagctccatctggcggtccgtggcacctttgtccttctcatccgcccttgcgaaatgagtgaagaggccctcgatgcggattcccggaagacggctgatccgcgctgtctcatccgccgccgctgcagtcaccatatagccgatccggctcatgccggtatccagggcgatgtggatggacgcccttttccccgcctgtactgccagttccgacagtcgctccgcgctttcatagcggaagatggccgggcggagatcgtactcgatcagctggctgaagctgctctccgggctcactccgagaatcaggatgggcttcgtaataccgtgtttcctcaatatgacagcctcctccggggtggccgtcgcgtatccgcttacgtaagagtcgatggcacacgccaccggtactgagccatgaccgtatccatccgcctttaccacaccaatcatctcagttccttcctttagattggccctcatagcttccatattctgtctgatggcgtccagatttaccgtctcataaactctgctgtatcgttccatttctctatacttccttcagcttattctgtctcatgattttataatgtctgccagtacttccgtcagttcccgggccagaaggccgtgctctcccgactgaagctttaccagatcccccgcccgtccgtgcaggtacacgcccatggccgcggcgtccgattcctccatgccaagcgccagaagtcctgcgataattccggtcaggacatcccccgctcccgccttcgccatggcactgttgccgctggtattgatgtaggtccgctggtcctttaaggccgccaccgtcaccgcgtccttcagcacgcaggtaattccataacgatccgcgtattccctcgcggtggggatcagacaccctctgatcgcctctaccgaacttcctgtcagcctcgccatctcaccgagatgaggcgtcacgatgatattctccgtaaaataattggtcagctccggaaatgccgcaatggtattgaggccgtccgcatcgaggataatggggacgtaggcattggccagcaccgtctccaccaggtttctcgtatacggctcctggccgattccggggcccaggacgatgacgctggcccattcacactgagcctccagaagggtctggaaacgcacggtaggcgtctgtgcctcctccgggtcgtaggtggtgatgatcgcctcaggaagcgcagtctgcaggatcgcccggttctcctccacggtaaagatcttcaccagaccggcccccatccggtatgccgccatggcgcttaaataggccgctccgctcatatttttcgaacccgcggcaatcaggacacggccgaaggttcccttattggaatatgccggccgggctggaatcatacggatatcctcagcttcataggtaaacagttccgggctcagcctctctaagctgaccggcggaaaaccgatatccgccacaacaacggtaccgctgtaagcgcgtcccggatagagaagcgtccccagcttttcatagccaaaggtcaccgtcacatcggccttcaaggcaattcccatgacctcccccgtgtcggcgtgaattccggatggaatatccacagccaccacgtaagccgctccgcatccggggagcgtggccagtaagtcccggtacgttccgcctacctctctggacagccccacgccgaagacggcgtcgataataagttcgcagcgccccggtataaaatcgctgtactcaatcagattcagacccagccgctccgcaatggccagctgtttcttgtattcatccgtcccattctccttcgtccctgccagaatcacggtcacggtatacccctttaaatggagaagcctggcggctgcaatcccgtccgccccattattcccagtcccgcagactgcccagatacggtcctttttctccgcctttttctgcacttcgcgcacaacggccgcggccgcctgctccataagcaccagtgaagggattcctatggactggatggtatagctgtccacttccttcatctggcttcccgataccagatatctcatacccattcgcctttccgactaaaaactcatccctcagtcttaacgatctgaaactcatctctgcatgttctctatattataatacaaaactgccggcaggcaaagaagaatttctcctttgcctgccggcactcatttcacaaacgaaatggatcaaaaggcaacggatcaaatcttatgatttcttacccgtatctgctttggcagatttgcctttttcccgctccgccttttcttcctctgccttgtcctgcatgctgcaaaccttataggataagcgcatcaggctctcagaaaggtgtacgttctccaccaccacgtcatccggtaccaccagatccgtatgggcgaaattccagattgccttgattcctgcgctcacaagacggtccgcaatctccggcgccttggtcttcggtatcgtcaaagctgcaatctgaacgtcgttatccctcacaaactgctccagatcatcgacacttctgatctcaatccctcgtacgacgagtccgataagacggggattaatatcgaacattcccttgatcagaaagcccctcttctcaaaattcgcataattggcaattgcctgtcccagattacccgcaccgataatcacaatattatgctgtctgtcgattccaaggatcttagcgatctccgtatataaatactttacattataaccatagccctgctgtccaaagcctccaaaattattcagatcctggcggatctgagacgcagtaaccttcatacggacacttaagtcattggaggaaattctttccaccccatcctccatcagttctccaagataccggtaatatctcggtaacctcgcaatcactgcttttgatatctctttttctgccacatcttcaccttcttcaatagtttgtttattccttttcatccctctgtcttacagcggcgagggacttttcgcttgttttgttaaattaactactattatacagtcatgacaaaataatgtcaaacaggttttatttttcttgcttgggcgttcctcttaatcgctgcagttcacagccctgccggcctctgcttcccggtctggcccggctggtccatgggccgtttccagtgactttgcagaggattagcaattcttaacgcgcaggatttttcgttcaggggaaattcccacctgtctgagcgcagcgagtttggggattttccctggtttttagaaaaattctgcacgtttagaagtgcttatccccgaaacttgaactggaaacggcccatggaccagccggggcagaccgggaagcagaggccggcagggttgtgaactgcaacactcaatccaaccagttgcagttgaaaaaaattccaacctatattatactattcgtgttattcaacatttattcgagccattcaaggggaggaactaccatgattttatcatgcagcaacataagcaaggcctttggaagcacggaaattatccgccatgcttccttccatatagaggatcatgaaaaggcagccatcgtcggcatcaacggcgccggcaaatccacactgttaaaaatcatcatcggagagctggccgccgatgatggagaggtcgtcatttccaagggaaagacactgggatacctggcgcagcaccaggagttgggcggcgataagtccattttcgacgaggtgctggaggtaaagcggccgctgattgagatggaagcaaaaatccgcagactggagcttgatatgaagcacgcttccggagatgagctggaaaacatgctttccgtctacagccgtttaaaccatgagtttgaacttcaaaacggttacgcctaccagagtgaggtaaccggtgtgttaaaaggtctgggctttacggaggaagaattcacgaagccggtatcggccctgtccggaggccagaagaccagagtctccctgggcaagcttcttttaacaaagcccgagattattcttctggacgagcctaccaaccatttagacatgaactccatcgcctggctggagggttatttgaccaattacgacggaagcgtcatcatcgtcgcccatgaccggtatttcctcgaccgcgtcgtcacaaagatcatcgagatggacagcggcaatctcgccgtatatcagggcaattacacagcctacagcgaaaagcgcgccatgatccgggacgcgaagatgaaggcttatttaaaccagcagcaggaaatccgccaccaggaggaggtcattgcgaagctgaaatccttcaacagggaaaaatccatcaaacgggcggaaagccgtgaaaagatgctggataagatcgaggtcctggaaaaaccggcggaagtcaatgacgagatgcgaatccgcttagagcctaacatcatcagcggcaacgatgtgctgactgtccgtgacctaagcaaggccttcggccccaaccatctgtttaaccatgtggattttgatatcaaacggggggaacgggttgccattatcggaggcaatggaaccggaaagactacgattttaaagatattgaacaacttactgcctgcggataccggggaaattcgtctcggttccaaggtgcatatcggctattacgaccaggaacatcaggttctgcacatggaaaagacgctctttaacgagctttctgatacgtatcccaacatgaacaacacgcagatccggaacattcttgccgcgtttctattcaccggagacgatgtgttcaagcgggtcaaggacttaagcggcggggaacggggacgcgtctctctggcgaagctgatgctgtccgaggccaatttcctgatcctcgatgagccgacgaaccatttggatatcacctccaaggaaattctggaggatgcgctgaacagctatacgggcacagttctctacgtgtcccacgaccgttacttcatcaacaaaacggccacccgcattctcgacctgacgggtcacacactggtcaattacatcggcaattacgattattatctggaaaagaaagagctgatgacagagctttacgcctcagagccgtctggaaatcaggaaaatggagcggaaggcggtgcatcacagactcccgagggttccgaagttaaacaggactggaaggcatttaaagaggaacaggccagaatccgcaaacggcagaacgacttaaagaagaccgaggatgagattcatcagctggagacgagggacggcgaaatcgacgggcttctcacccgggaagaagtcttcaccgatgtctcccgcctcatggaactcaacaaagagaaagaagagattcagacaaggctggaagaactctatgaaatatgggaaacgcttgctgaataggaacagttccacccgactcgctgcttgcgggaataaaaagaatccaccggaagacgtatcgtctcctatggattcttttcatttatggtctcaatccgcttccaccctgaagtgtaattgtttcacccgtcacataactcgcgtcgtccgatgcaagaaatacgcagacacgtccgatatccttctccggatctgcaaatcgcttgagaggaatgctctgaatcgtctggtcatacagttttggatactcatctttccacttttccagaccaggtgtcatggccagcgggcagactacattcacattgattccaaactcgccccactctgccgctgccacacgggacataccgcgaattccctctttggctgccgcataggaagactggcccagtttgccgaacaggcccgctccggaggcgaaattgattacgctgccttttgtctccttcaaatacgggaatgcctctctcatatagaaaaacgtcgcatacagaccggaatagatcgcaaggtcgaaatcctctttcgtgtggtccaccagcattgtgccggacttggaaacctgtgcgttattaacaagacaatccagcttgccaaaacggtcaaccgcctgctttaccacgttctttactgccgcctcatcgccgccatccgcgactacaaacagcgcctcgatgccgtaatctgcttccagattctctcttgcctcgatcagtgtactcgccgtacgtcccgtaataacgatattggcgccctcttctgcaaatgcctttgcaataccataaccgatccctctcgcaccgccggtaatcagtacgactttaccttccatcttcttcatggatgccgcctcctcattaataataaaaacgatttagattgaactaagatatgcttttcatttataagttttttctattttgttaaataattaacgttctatgattagtatatacctgatgccttcaggagtcaagagtaaataagtatttttttatcgattaatttgtaatgatgtcttttacaccgcttcggttattcgtatcctgttttctgcgtctattatctcctgtcttctgtctccctatcctttcagaagcaataaaaaaacaggattgctcctgcttttttatcgttcctattatttttcgtatataggtttcattccacgcttagtcatttcgcaaagtgccgtctattttgttgtttcaatccacgctcgatcatttcacagagtgcgactacatcttatagatgcgcggcttgacttcatgtcagtggggaaattctcgcttgttttgttaaagccgcttaccgcgcatacaaaaccttcctcaaaatctcacagacctgaggcgaatccgcttccatagcggttctcgtatcgttgtcgcttaagtatgcctccaccagcttcccgaaataaaactgcatgttgttcgtgtaataatcggggacatcgacgaactcatccacattccccttattcatggccagatccacagcgaactggctgtcgctgtcaaagcagtcagccgcgtatccgatgtattctccaaaggcctgggtcaatccctccggcttgcagaacttaatcttccggtagctcgtatccagcttatgatatacatagtatgtactgccgtcggactctggcgcggaaaaatattccttatccggataatagagaatctcccatccgtgatccacaaaatacttgatccagcctctcggaatatgctcgagggctgctgtgatctcctctttcgtctcagatgccacagatgattccttgctctttccttctatcacgatgtcatagcgcttatccctctggccattctcgtccatgtagaacagtccaacatactgattggccgccatctggccatcctcgaagaaataataccgtttcccgtcgatcgacttataaccggaagaagccatctcccctcttgtggagaaccagtaccagcttccgtcttcatcctgaaaccagcccttcttcgcagtgccatccgcatcaaaattgtaccatttctcatcgtcatcattatagcaccagccgattgccagatctcccgtctcccggaaacaatagttatatccgccgatcttctgccagcccacagccataaggccatccttgccaaaatggtaccagtaaccgccgatctgttcccagctgttcttcttatacgttccggcttcgtcataatatctccagccgccgtcttcctgcttccaggttccctttacttcattcccggagtctgcctccgacacctgcccggcggtgttctctgacgttccgtttgccgagtttccattctctgcagttccattctctgcagttccgtttgccgagttccctttctccgcggttccattctccgcagttccgctctctgaagttgtgttctctgtttgaacggtccccgtctcatctgccgcggccgccatgacgcttccgaggcttaagagcatgctcactgcaaccgccgctgcccatcttttcttcaagaatacacactccttccctactacaatatatttatggttaatattccttacagccagtaaggacttatccatcttgttgcttaagctgttataatgatggagcaatcggtatatcggcttcctttcctggactttgcgtccgtaaaaacagactgataaccagctcctcattcgcagcgttcgttttatgcaggttgaactgcctccggtacgttcgtgtcacaccacagtagatggaataggcaatgagttaaactggtacttatccattgcagtaatcttaaggagtaacaagtttatgaatatgaacgcagtaggtattgatgtttccaaaggcaagagcatggttgctattcttcgcccttatggcgagattgtttcttcaccgtttgaaatcaaacatacatcttctaacatccagtctctgattgaacggattaaatctatcgaaggtaactcccgcatcgttatggagcatactggccgttattacgaaccacttgcccgtcagctttctctcgctggcctttttgtgactgctgtaaatcctaagctcattaaagatttcggaaataattctctccgtaaagtaaaatcggataaagctgatgctgtaaaaatagcccgttatacacttgacaactggattgatttgaaacagtatagtcttatggacgaactacgcaatcaattaaagactatgaaccgtcagtttgggttctatatgaaacacaaaacagctatgaagaataacctcatcggtatcctcgatcagacttacccaggtgtaaatactttctttgatagccctgcccgtgaggacggcagccagaagtgggttgattttgccactacatactggcatgtggactgtgtccgtaaactgtcattaaacgcatttgtcggccattatcagaaatggtgcaaacgcaggatgtacaacttcagcaaagacaaggctgaagaaatctatggagctgccaaagagcttgttcctgtacttccgaaagatgatttaaccaagctgattgtgaaacaggccatagaacaattaaacactgcttctaagaccgtggaagaactccgtaccctgatgaatgaaactgcctctaagctgcctgaatatcccgttgtcatggaaatgaaaggcgttggcccatcacttggccctcagcttatggctgaaatcggagatgttacacgctttacccataaaggagctatcaccgcatttgccggtgtggatccaggcgtaaatgaatcaggaacttatgaacagaaaagcgttccaatttccaagcgaggctcatcttcccttagaaagactttgttccaggtcatggactgtctcgtcaaaacaaagccgcaggatgaccctgtatatgcgtttattgacaagaaacgggctcagggaaaaccttactatgtctacatgaccgcaggtgctaataagtttctgcgtatctattacggaagagtaaaagaatatcttatgtctcttccagaataaagaatgccacaacctttcagaccagcggataacggtggtctatttgttgtacttgaaatttcatcaacaataactcttaaaaacttttcattatactattgactttttatttgcaggctgtcttttcacacgttatctccctctgattgtactataatctggtaaaaaagtacaggttgcaaatctgaagtttttgtgaacaaatcccaaatccttaccttgagtttccgaagttttctgttataataaagggaagtaccatcccaaagaaagcgaggtgtccccatgaaatggaaacgccctctggccatggccggagttatattcatactggccatgtatgttatcgccatcgtttcggctttctccaaaagtccgtccgcaaataactggctgatggccgctatcttctcaactgtcgtcataccggtcatattgtatgcttttcaactggtgtacaggctcttaaatcctgaggaaaaagacagaaacaacgaatagaaaaaaagacggccatatccggatggttctttctcggatttggccgtctttcattttctgccaatgaataaggacagtcttatctgtatatgatctcgtctctacccggtccattggaaaccatggtgatcggagtctcaatctctttctcaatatattcaatatatttccggcagttttccggcaggtcttcgtactttttgataccacggatttcacatttccagccaggaagtgtctcgtagaccggttttgctcgctccaaacggactgtagtcgggaaatccttcgtaacctcaccgtcaatctcataaccgacgcagacgtgaagctcatctaaatatcccagtacatcgagaacggtcagggccacctctgtggatccctgaatccggcatccataccggctcgcaaccgcgtcaaaccagcccatacgtctcggacgtcctgtggtagctccaaactcaccgccgtcgccgccgcgttttctcagttcatcggcttcctcaccgaagatctcgctgacaaatgcacctgctccaaccgcactggaatatgccttcacaacggtagtgatattctttatttcataaggcgcgattcctgcgccgatggccccataagccgccagtgtggaagaggatgtaaccatcggataaatgccgtggtccggatcctttaaagagccaagctggccttccagcaggatattctttccctctttgatggcatcatataagtattttgacacatcacagacgtaaggagccaccatatcacggtactgaagcattgtctgaaacagctcctccgggtcgagaaccggcttgtggtataaatgctccagcatcacgttcttcgtctcgcacacctgcgctactttttcctttaaggattcactttcaaacagctcgctgacctggaatccgatctttgcatatttatctgaatagaatggagcaatacccgactttgtagagccaaaggacttcttcccaagacgttcctcttcatactggtcgaacagaatatgatacggcatcagaatctgcgcacggtcagagacgagaatgtgcggcttcggaacgcccttgcttaccagctcgtcaatttccttaaccaggaacgggatgtttaacgccacgccatttccaattacgctcgtcgtgtggctgtagaaaacgccggacggcagaaggtggagcgcaaacttgccatagttgttgatgatcgtatgtcctgcattgctgcctccctgaaaacggatgataatgtcggactcattcgccagcatgtccgtgatttttccttttccctcatcgccccaattggcgcctactattgctcttaccatttgtttgtttcctcctttacttcactacggtttgcgggggggcttcgattttgcttcgttctgcaccgcggcgggcttcgattttgcttcgttctatcccgcagtggacctcgattccgctccgctccatctcggtcacgggcttcgccctatggaatccggtaagcggcaatctgctttcatgcaagcatgacgcagattgccgcttaccggattccacactgctcattgccaccgcgtatatcatagctcaaagcacatcataagtaaagtcaatattatttatgttttccataattttcagttatatcattggtttttccggtttttccatcaatagttccagcagacggcctccggcgggagacatgggattttttcggtctgtgatgatgcagaaactccgctccggcattccctgcttaaattccagttcaaacagatggcctgcttcgatttccttctctgcaaactccgacatcacgcagccgattccaagattcctcatggcaaactggacaatcatatcactggtcgccagctcgaattccggttccacgacgatacccagcttctctaaaaaatcatccataaaccgtctcgtactcgtattcttttccagaaaaatacagggaagttctttcagaataccgtattccagccttttcccctttaaatgcttaaactgctctcccgccacaaaaatattccggatcttctttacctcagtgacagagacctccggcctcgcatcgaccggggagctgaccacgccgaaatcaatggttccatgacttaaaaagcccagtgtctccggtgtggggccgttggacaccgttaccttaaccttcggatatttctcgtgaaaacgctccagaaacggcagtaaataaaactgaagcgtcatatcgctggctccgattctgacctctcccgtatccagatcctgcatccgccttaacatattctccccataccagatatcatctaaacccgatttcacataagaatagagaagctctccctctctcgtcagcctgacacctttggaggtcctgataaacagcttcgcatcgacggaaagctcaagctggcggatcgcctggctgacggccggctgggagatgcacagcttctccgcggccagtgtgatgctgcctaactgtcctacataataaaacaccttgtaatattccagattgctgctcataccgtatcctcctgaaaagagcagagactatcgatcgcctctgctctgaatccattcttattctgcggaagatcactgtttttatacccgtctaaatggtcttcctctggcacacatttatcttacacatttatcttacacatttttagacattaatctcagccgtcatcccaagaacatcctgattcgcggaaagcagcggccgaatcacttcatccagatagatctccacctgagccggcgcgcatccgacatacttcttcggatccatgttctgcttaagctcatcaaggcttaaattgaacgcaggatcggcggcaatcagctccaggagattattgtccataccgttttccttcacatttcttccggcctccatggacagctcacggattctctcgtgaagctcctgcctgtcgcctcctgcttttacggcatccatcataatattctcggtagccataaatggcagttccgccatcatgtgtttctcaatcaccttcggataaacgacgagtccgtcaactacatttaagtaaaggtccagaataccgtcaatcgccaggaatccctccggaatgctgagacgcttattcgcggaatcgtccagcgtgcgctcgaaccactgggtggaagccaccagcatggggttcatcacatcggacatcacatagtttgacagagaggcgattctctcgcttctcatcggattgcgcttgtaggccatggcggaagagccgatctggctcttttcaaatggctcctcgatctccttcaaatgctgaagcagacggatatcattggaaaacttgtgtgcgctctgagcaatgccggccagtatatttaagacacggctgtccacctttctcgaatacgtctggccggaaaccggatagcagcccggatagcccagcttctctgcgatcatcggatccagctttcttaccttgtccatatcgccgtcaaacagctccaggaagctggcctgtgtgccggtggtgcctttggagcccaataaacggatggagcctgccacatagtctaaatcctctaaatccatgaccagctcatgcatccacagtgtagcgcgttttccaaccgtagtcggctgtgccggctgaaaatgggtaaatgccagcgtcggctgatctttgtacctgtctgcaaacttcgccagctccgcaatcacgttgaccagttttttcctgactaacgccagcgcttcggtcataacgataatatccgtattgtcgcccacgtagcaggaagtcgctcccagatggatgattccctttgccttcggacactgtacgccgtaagcgtacacatgggacatgacgtcgtgacgcacttctttctcgcgctgcttcgccacatcgtaattgatctcatcctgatgggccttcagctcatcgatctgttcctgcgtaaccggcagccccagttccatctccgtctcggcgagagcgatccagagcttcctccatgtgcggaatttcttatccggtgaaaatatatactgcatttctttgctggcatagcgctcagacaaaggactctgatagcggtcgttcataaaaatataccaaggagactgatggctttcgtcatacggaggaaccggcatgtgactgataccgtttccacgtctccaccctttcatttgattttatttcaatccacattttgaggccagaatacaaaacccagaatgacatagtagctatgctgccattttatccggttgcccggattgttttgacctcatgtcagtgggggatatctgcccgccactgccgctaagtttgtttttgcgattcatctcccacctgcagaggctgggagaattctcgttgatttttgttaaatatcatatcataatatgctcacagttaaaagcaaaaaatcacaaaatttacggttgtgccggatcatgccgaatcttctccatctcactgccgccctccctgcataaaaggcgccgggccggatggtgacacaatccggtgcagcgcctcttttcttctgcggaatctctgaactactgcacatacacgttcgcagatttccggactactgcacgtacacgttcccagatttccggactactgcacgtacacgttcgcagacttctgaactactgcacgtactcgccccggatatcctcctcaggcggctggatcggatactcaccggaaaagcacgcagtacagattggcagtccctgcgccatttccgtcagccgttcctgtcttaagaaggacagggaatccgcgccgatcatgtcgcagatctcctgtaccgtccgaccgtgagcgatcagctggtcctcggaaggaatatccgttccaaagtaacacggatggagaaatggcggagcgctgatccggacatggacctccttcgcccctgcttcccgcagcatcccgacgatcagagcgctggtggttccccggacaatggagtcatcaatcatgatgacgcgtttgcccgccacagcctcctttaagacgttcagtttaatccgaacggccgactcccggctgctttgcttcggcttgataaaggttctgcccacataggagttcttgacaaaggcagtgccatagggaatttgggattccatggaatagcccagcgccgctccattaccggattccggaactccgaccaccagatcagcctccaccggtgaatctacagccagggcacggccggcaagaattctggcctgatagacgctcactccgtcaaacacgctgtccggtctggcgaaataaatgtattcaaatacacatctcgcttccctgctccggtcctgaaagcacagcctcgtatccgatgcgataccatccttcgtaatggtaacgatctcacccggtttgacgtccctgacgaattctgctccgatcgtatccagcgcacagctttccgacaccagaatataggcgttgtcccgttttccgatacagaggggcttgaatccgaagggatccctggccccaatcatttttctgggactcatgacaacaagggaatatgctcctacaatcttcttcatggctccggcaaccgcctcttccacagaagatgtcttcacacgctcccttgcgatgtggtaggcaatgacttcagaatcaatcgtagtctgaaaaatcgcccccgaatattccagctcccggcgaagatccggcgcattgacaagattgccgttatgcgccagagccagagtgccttttatatagtttaaaaccagcggctgggcattttccctggtactgctgcccgccgtcgaataacgaacatgacccactccaatattgccgtgaagaccttctaatatctcaggagtaaagacttcgttacacagacccatccccttatacgcgtttactttccccttggggcccgccgtatcgctgaccgcgattccacagctttcctgccccctgtgctgcaatgcgaataatccgtaataaatggtagacgccacgtccccgtgatcgaaatcatacattccgaagacgccgcactcctcatgtaactcatcccccgcagtaatattcaagtcatgtctcatgtagtaatgcctttctgtgctgtttactggataccaagacgacggaatacttcttcataagcgtcttctacgttacccatatcgcggcggaaacggtccttatccagtttttcatgcgtttccttatcccacagtctgcaggtatccggagaaacctcgtcggccagaatgatctgtccatggtaacggccaaattcgatcttaaagtcgatcagctcgatgccgaggctgtcaaaatactctctcatcacttcgtttaccttaaaggtatactttgtgatcgcgtcgatctcctcctgagttgccaggttcagtgccagtgcgtagtagctgttgatgaacggatcgcccagatcatcatttttatagctgaattccagtgtaggacaagcgaacttgatgccctcttccatgcccatcttctttgcgaagctgcctgcggagaagtttcttacaattacttctaacggaacgatctctactttcttaacagcggtctcacggtcgcttaattcctcgatgaaatgagtcggaacgccttctgcttccagcttcttaaagatgtggtttgtcatgcggttgttgatcgcaccttttcctacgatggtacccttctttaaaccgttgaatgccgtagcgtcatctttataatccacaattaatacgtccggatcctctgttgtataaacctttttcgcttttccttcatacagtaattcttttttctccatggtatccaccagtccttttcctgaattaatttataagttttatgaatataaccaaggtatttcagtagaaattataatacagtgaaaatgcgattgcaacatttttatatattataaattcttatgggcgatggctgtattcacatataaatgcgccggacgccgcattaatccggtctgttctccacattttcacggcgaagcttctcctctgtccgccagaattccaccctgccctctttccagtcaattgtaactccgctgtcctttttgtcagatgtgggcacatcttctaaagttccaaaatccgccgtctccaccgtctcttccttcacgcagccgatatgaaatcgacgcgcggcctccgtaaaaataccgggatcatttacacctataacgatcagctccgccagagccatacagcttaagcagtttctgaaaatgtgtatacgccttcccatagacgccctgagaaagccgcggcttctccacggcttcttactccggttataccgtttcatccgttgtttttctgcaaacagggtaatcttcaaaaagcctgtcccttctttctacgcattagtcattcgttgcatttccatcgccgttcaccggaatcgcttctcccaggtacgtcggctccggcttgaagattccggtcataaagtctttccctctggccagcagctccctcacatcacgccgcttctgaccggcgtacgtcctctggtcggaagccacgccataagcgtcgagtcccagctgtttcgcggcatacagtgccctgtagagatggtagcgctgtgtcacgatgatcaccttctccgcctgaaacacatcgcgggcccggtacatgctctcgtaggtggaaaaaccggcgtgatccataaacacatcctcggaaggcacgccgcgggccacggcgaactgcttcatcacgttcacctcgtcgtaatttttccggccgtgatctccgctcatcagcagcttctgagaagcgcctgcgtcatacagctcgatcccgcgaagaagacggtcctccagcatgttgctggggtttccatccggatggacccccgctcccaggacaaggatgcagtccactcccagcgcggccgcttcctcctgtgtgagaatccgtttttccgtagatttgatcatatatgtattgacgcccgccaggcagacaataccggcaacgcccagaacgaccagtgcaataaatgccttttttatcagttttttcattcttttgtcctcatttctgttatacgctccattatataacaaggaaaaaatggcttcaagcctttccgggcctaaagccattttatttttcgtctctgtataaaaatacttattctgctgcagagctcatatcagcactgttggtcggatggccgttgctctcgccagttatatcatcgacacctctctcaacatcattgatcatgccatcgatgactccggtgctttcctcagcgtcttcatcagcatttcttgtagtccccatatcttttgtggactccattgccgttgtctgcgttgtagctgcgctgctgcctccggtggtctcatttgttgtgttcttattgctgccgcatgcggacagacacatcactgtcataatgacaagtactgcaaatacatatggttttattcttttcataatacattctcctttcattttctatgcttagtatgtgttagaggagaaaaaattatggtgggaaatttttctaattttttaatggcctaaagccggagaaacagcttaaaagttcttgcctcaaagtcattttgtccgttctgcagaatataaaaaaaagttcatttccgtattcctaaaattctttgcagctttatcaataattttcataccatttcgaacagcaacattttgagaagctatatgtgtgtcccgaatcatagagcagacgctgtctgcatcgagaaccgtgaacgcatattccctgcacgcaattgccgcttccgctgcatagcctctgtgccaatacgccttttgaaacaaatatcctatttccaaaagctctttctctttccactgctgtagtgtcaagccacactggccaatcatctcattagtttcttttaatacaacagcccaaagtccaaagccataatcttcgtatctttttaaatgtctgttcagccaattttgcgcttcatctgggctgaacgcactttcataagcagccctcatcacttcttcatcacacaagattctgcacaatgcatcaaaatcggattgctgcatttctctgatcaaaagacgttccgtttctattaaaaatttcccgcttgccaaatagcacctccacaaattcaaattttaaaatttgcttttttcgactaatgtgaattggatctatcgctctgcaaagtgactttgtaaagttggtgcggcatttggggtacaggcaccgtttacattacccgctatcttctgatcgctggaataagggcgtatgctccatttccggcggtctaaatgtccgttcatagaaaacggaggcgcagccgaccctgcagggccttcatataaggtgcattagagcagacagacaaactgaaagttgcacactgatccatgagtccaatttactgaaacaatatatcagagtattccgttacttctttcgattctgccatacatattcaattaaactggtaaagaatactcctaagaaaaatattatttcaaattctaaggttattttaaaagggttattagatattaaaccataaagaatatatagcaaactacttcctacagtaatgaaaagtgttttcaaaagtgatagtattactaagcgtttcataaaattccttctcttttctatggtgtgagttgttatggttatattgtcagtctattatatatgctaaattacaatttgttaagtacgccttatttgactaatgcgaatttagcaaaatagcctgattgctccggccaaaatactatcttctacagatcaacacggcatgattgctcattcctgtgcatgattcataacttgccatttgatcaagcagcggtttcatgattttaaatctttcatcgctcatcgcttccacgatactcatagttacaaaaaaatccgtccctaaattttttatcttggaaaatccgtattttcttgcaatggattccatttcttcaggcatcgcaaagaagaataaatcaggatttgagtcatctttattttgcgtcaaaataatttcgttggcgttttcgttcggataatattctctcagtttgtcgtgtacacaggcacccgtataaacaccgattttgcttatatatgaaaatacaacaattccgttatttttacagattcgcctgcattcagcaaaaacaagctctctctcatcgggcggcagatggtatagaggtccgaggcacagaaccacatcaaaatagttgtcagaaatattgctcaaatttgtggcatctccgattaaaccttttacgttccttagcccctgcgctttaactttttcattaaaaagggcaatattttcaggagtaatgtccacgccaacatactccttacatttatcagaaaagtgcatggcataatatccagttccccatcactaatatgattatctttctgcttccgaaactgtttgatccactggtatttctgtccataagaatctcctttacacgaaattatctaaagatgctttttccttcaaactgatttgggggaaataagctgcaactgcgccttttgcatcaaatcacaggaaagattcatcccgttctcctccaccataaaggaacagatcttctcaaacccgtgtgcttcatagaatctgatcgcccgggcattggaggacagcacctccaggacacagctccggaacccctgcgccctcattcgggcctcgatttcacagtaaaacccgtccccctctcttagccgatcacatccgccatggtataaagtctcggttcttttcccgccaggaactttgctgccgatactgcgccctttgcaaaaatagccttggagtaggcggtatgctggaaggtaatcacctcatcctgtccggcgaagatcacgtcgtgctcaccgacgatagagcctccgcggatagcctgaattccgatctcatccttctggcgcttctccctcgtctgggagcggtcgtattgatagtggtagtggttgtccatcgcctcattgatggagtcagccagcgccagagcggttccgctgggcgcgtccacctttttattgtggtgcttttccagaatttcgatgtcgaaaccggactctgccagaacctctgccgcctctttcaccagctttaacagcagattgattcccagcgacatattggcggaacgaagtaccgccacctgacgggaagtctcttccacaagctgaatctgttcttctgaaagtcctgtcgtacacactaccacaggaatcctcttttcggaacagtagctgagaagaccgtttaccgcctttgccgatgcaaagtccacgatcacatccgcctccacggtacacgcctccagagagggaaataccggataggaattctgtatggtgtcatttacatcaattcccgcagcaatcgtaatattctcgtcttcttcaacaattttagaaatcacctgtcccatggctccattgcagccgtgcataatcatctttaccataagtatttttcctccattttataatgagtgctgggaagtttctgtgagtgctcaacaggccggacgccctgttaccgatgcgtccggccctgcatttaatgattaacggggtttataaaattccgtattcttccatagctttctttaaacgttcctggtttgcaggctccatctcggtgagcggcagacgaagcgggccaaccttcttacccattaagttcatggccgccttgaccggaatcgggttcacttcacagaacagggcgcctatcagcggaatcgcttccagctgaagtcttgcgctctctttcacatcgccgcggaaataggaagcgcagatctcgtgggtctgtgcaggcgctacattggacagaaccgaaacgacgccctttcctccgagagagagaagcggcacgatctgatcgtcgttgccggaatatacatccacacagccgtctgccatcgcaagcatcgtagcgatattcgtgagatttccgctggcctccttcacaccgacaatgttcggcacgtttttacagagtgttacaatcgtctgcggagcgatcgtcacgccggtacgtcccgggatattatagagaatgatcggaatcttcaccgcatccgcaatcgcggtaaaatgtgcgatcaggccattctgagtcgccttgttataatacggggacacgagaagcagaccgtctgcaccgaatttctccgcctcctttgaaagatagatggctgtctccgtacagttggaacctgttccggccactacgggtattctcttatttaccacttcacacgtatactttattacgcttaaatgttcctcatgggtcatggtggatgcctcacctgtggttccacagatgacgatgctgtccgtaccgccggcaatctgctcttccagcagttcttccagcttctcgtaattcacctctccgttgtccttaaatggtgtaatcagcgctacacccgctccttcaaaaagtgccatagtcttatcctcctgattcaatctgttcctgttgccaacgcttccgctacataaaatcatgcgcccgccccgtgccattatcctgctcttatccttttgcctgcaaaacgatcattcctgacagagaaaaagagctgacagcggggtcagctcttaaagttcagaatccggtaaatacttcttatcttcaagcagcgccccatccatgcaggatgacagtcatatgattcttcatcatatgcccagaacagatacgtcccgggccgtaccgtccttcggcgtctcatcctttcctccaccctcacatgcaccctgatgcatcaggcagaatactcataatcaacgcaacctctactttattatgtatgttaccatactaccattattgctttgtattgtcaactttaagatgatcaatttctctgatgccatccacgaggggatccagctccttcgggaatacctttccagtcagaatcaggtcgatttcctcaaccctggactgaagcagcgtcgtcatctcatccatctcgataatcccctgatccaaaagtcccagcacctcatcgagaataaccaggtcacactcaccggtcgaaagtacttttcttgcaaaattcatgccgttgcggatattcatccgttcttccttctgctgctcctccgataatgtctcgaagaaagcatcggacttttcaaaccggaaaatcttcagttccggttccagccgctctaaaatctcacaggaggccagctcctgacagccctttaaaaactgtatcatgattaccgtctgcccctttaacagagcggagatccccatgccgagcgcagccgtcgtctttccttttccttcgccgcatataacctgtattgtacctttactcatccttttgcacctcataccagcaaaaaagcaatatattgatatactacgttagaacccgcttatcgtatcacaaaatttaaatttttgcaagttttcttaccgttttcttaattcccgccttatccttcgttattccgcgcattccagcttgctgacagatacctcataagcgatccgtttctcacactcggtttcgctgagcttcttcgtatactctctgctctgcacgcggccccagaccttcacccgcgcgccgacttcgaagccggaggcgtatctggcgtttcttccccacgcgatacacgggatgtagtcagacttcccatagggccggtttacggcgagcagaagatccgcgatctctctgcccagaggagtctttctgtatataggggccttacatatatatccatccagaaaaatctgatttgttttcgtataatccgtaaattcctccaggaaatggatctcacgcacgaagatggacagaaccaggcggtttttcgtcccttcatgccggttataggaacggaactgtcccagggcttccatagtacagcctatgtaatccgcttctacatcgatgagtcgctccgatatcataagaggtatgacatcagcctgctcgctaagacgatttactgcaacgtccaccatatagaatccttctccgaatacctcatggctgaaggtgaagccggagatgatctccccgattacgcttactttgttgttctcaatcattttttccgacattgtatttctcctcttctttcactaatttgccgtaacgattcagccgggcgtcctgcgtattctgttttcctgcttttgaaaacagaaagatgcacggatgaatggttacaatttgctttgcagctaatattaagtgtatgaaaagggattccgtgaaatgataagaacacatccaaaaatatcgacagaaaatacctgtcaaacctcacaaaaaatcagttacccccatatttccccgaaataccggaggccggataccggcggcttctcttttccttccgttttcgacctttatcgacagtaagcggatttcactatttccaggatgcaaatatgccctgcgaaagtttcctcccgcagagcataatcttatatacagccgttgtcggtatagctaatataattccattaacccaatgatttcttgttcagggaagacctcttcctcatcgtcggatccaggatcttctttctgattctcaaggataacggtgtgatctcaaggagctcatccgtatcgataaagtccagacactgctccagactcatctcctttggcgtcgtcagcttcagggcatcatccgcgccggaggaacgggtattggtcagcttcttcatcttgcagacgttaatctcgatatcctctgccttcgggttctgaccgattaccataccggaataaaccttcacgccggctccgatgaacaggatgcctcgttcctgcgcattgaacagaccgtaggtaatggattcacctgactcataagcgatcagggagccggtcttacggtaggataaatctcccttgaaaggagcgtagccgtcaaatgccgtattcatgataccgttaccctttgtatcggtcataaactcaccgcggtagccgatcaggcctctggacggaatcgagaattcaagccttgtatagccgccgttagccgggctcatgccctgcagttcgccctttctgctggtcagcttctggataaccgcgccggtaaactcctccggtacgtcgatataggcgatctccatcggctccagtttgcggtttctttcatcatactggtacagaacctcagccttgctgactgcgaattcaaaattctctcttctcatgttctcgatcagaacggaaagatgcagctcgccgcggccggataccttaaagcagtcaggagaatcggtctcctccacgcgaaggctgacgtcggtgttcagttcgcggaacagacgctctctgatatgacgggaggtgataaatttaccttcctgtcctgccagcgggctgtcgtttaccatgaagttcatggcgatagtcggttcggatatcttctggaacggaatggcttccgggttttccggagagcagagcgtatcaccgatatgaatatccgtaataccggaaatggccacgatcgcgccgattcccgcttccgtcacttccaccttgttcagtccctcgtactcgtacagctttcctaccttaaccttgcgcatcttgtccgggtcgtgatggtttacgatgacacattcctgattgacacggatcgctccgttatccaccttgcctacgccgatacggcctacgtactcgttgtaatcgatggtgctgatcagaagctgagtcggcgcttccgggtctccctccggagccggtatatggtcaatgattgtctggaataaggcgctcatgttctcttctgcgtcctctaaattcttctttgcaaaaccgccctttgcggatgcgtataagaacgggcagtctaactgctcttctgtcgcatcaaggtccatgaggagctctaagacttcctcttcaacctcgtccggtctcgcctccggacggtcaatcttattgatacaggctacaacggagaggcccagttccagcgccttgcgcagaacaaacttcgtctgcggcataacgccctcgtaggcatccaccaccagaataactccgtttaccatctttaagacacgctcaacctcgccgccgaaatccgcatggcctggcgtatcgataatgttgatcttcgtaccgttgtagttgacagcggtattcttggaaaggatggtaataccacgctctctctcaatatcattggagtccataacccggtcaacaacttcctggttctcgcggaaaattccgctctgtctgagcagggcatccaccagggtagttttgccgtggtcaacgtgggcgatgatggctacatttctgacgtcttctcgtttcatcttcataatatgtgtactcttctttcctttggataaaaactcaataaaaaactaaggactctatactgtccttagtttcatttacactcttcacaataaattagtatagcaccctatataccagattgcaaggtgtttttcagaaatttggctattgcctttccagtcttttcactttcgccggtacattcctcctgatccgacggttctctcacccacccgaaaggcatagtcaggcagtcttaaacagccgcaggaaagacggcacaggcagctgcctgccactgtattcccattccggagaagttcttctctctatcattttatagtactggtgttccgcttcccttgccaccgtctccgccttatataaggaagcagtttctgcggctcccgccgataatttctgataaagctgcggttctgtcatgaggcgtgctgcggcagacgcccattcttcttcctcttctccggtcatgaatccgttctttccctggctgacgacatcgacgactccgctggcatggaccgcaactacgggacagcctgcggccatggcttccagaagaacgattccctgcgtctccgatttggaggcgaacaaaaatccgtcggccgcatggagataatgggatacctcggcattgggaacccgtccggcaaacacgatctggggtccgattccaagctcctctgccagattcttaagcgtctctttcctcgtcccatccccgattatcagaatgcggaagcagtctcccaccagttccttgagacgggcggctccccgcagcagaaattcgagattcttctccttttccaggcgcgcagtcgtggcaaacagccacggttctccgtttaaataccgcgatcggatctccttctcactctccgggtcccgtttaaatgcctcctcgccaattcccgtaggaaggacctccagcggtgtcgcaactccctgtgtcaccagacattccttcatcgatgctgtcggtacgaataccgtgtcacactgatccgtaaatgtattcagataccctggcaccagcacttccctgctgaaacgcgctgcatttctcactggctcccgccccgccgccatcctctcatacaatttaaaatagtgaagatattcctcatagcgggtgtggtacgtatacgccagcggaattccgtattttttgcttaaatatacggcggtaaatcctattaccaccgggtgatgtacatgaataacgtcaaattgttcttcgcggaaacgcttctcaatgcggctgtcgctgaaattgccgattaccagccccttgtcccgccactcgtaaaggacccggaatctcaccacatccggctcttcctcccatcctgccccctccggtgcaaacacggtcacctgatgccccaggctccgaagcccctctgccagcctctcaacggaaatcggaacaccgccgatgaatggtttataattgtttgtcagcattgcgatcttcatttcgctcctcctcttatgaaaacagcctgatcgccctgtcacccagccagtaaccggctcctatcaggaaaaaattccatacaaaaattccaagcgccgagctcacgctgtatttaataaaattcatgcggatcactccggccggaatggagatcacggtcctgaccatgggaatcagcttgctgataaagattccgatggccccccgcctctcaagcatggcgaagttcttctctatgaccggccgctgggccggaaacttctttaaataccgttccagcagtacatggccgcccagccttcccagcccgtacagaatccagcttcccagcagtcccgcagccagcgccagcagcagcgccatcccaagtccgatctgccctcttgcggcccagatccctgccagcggcatgataacaccggccggaaagccgggaagattcaaatactccagcaacacaattacaaatataaaaactgccccgtactgcagaaaatactgtgtcaatgcctgtatatccataaaaaaacctccttgatgatagtatcataaaggaggaatcttaacaccacttgctgatttcactgaaaaaaagaaggataaaaaataaatattatcttaattccacgcaccgtcttccgcgaccgtatacccatccggtgtcacgcatccgctgtacatcgctccgtgaggacgataagacgcttccgttttttcgtagacccagcggccatttaccagactccagcctggacttccttcggtctggggagcgaagtaataccagacaccgttaatcgaattccacccttctgccatagagccgtccggttttaagtaataccagaagccatcggattcgttaagcagccagccggttttcatggctccgctggaatccagccagtaccattttccattgtctaaaagccatcctgtcgtttttcttccattggtgtcgtaatagtaccacacctcgcccgatttcttccagccgctgttgaatccagaagaggagcctgaagcggaacctgaactgctgctgccggatcgtttgaacacgccagtcagatgtgtatcttcccggagcacaaaggtacagcggccgtcgctgccggcagtaagcgattttccattggccgacaggcctgccagacggtaaccgctctggggaactgcctgcacggttacctttgtgcccttctttccgctcatgggagaggccgttatcctgcctcctgtcaagtcttcttcgatcgacacctggaagatttcttctgcggctgttgtcttatctcctgtcagatataccctggcactgtccggaagtacaaaacagattctcccggcttcctccaggctgactgacagtgactgtacctctccgctgccggtgtctgagtatgcacgaatggtgtctgtctgtacctcgtcctcagaaaactgcatccagacgttcgcaggagccttccaggccaccgggccgcttctcacaccattttcatcttccagacagagctggaacttatacgactggctccagtccccgcgcggtctgtcctcaggccagtctgcatcgctgttttctgtcactgttaatatgacggaatgtaccgcggcgcgcactcctgcctcctttttctctttggacgaggccgatgccggggaatctgctgttgacggggttgctgttgacggggttgctgttgatggggtcgctgttgatggggtcgctgattggcgtgcggctccgaacgctttataaccggcattggagggcgtagccttcttcgcctgggatggggtcgccggcattaagctgtcatcccacgggacactcagcagaagtcctgccgccgtaaccgggctttccataagctctggcgtctcaaccctgacctcaacgcgattgccgcgggccgccataacctctctgtacagttcttccaaaaccagaagatctttcatgcagtactctgccagttcttcgtttgatacgctccagactgcgctgaccgccgtcttcactgcctttaccacatcgaaagctccgtaatcactggccgcctctgctgtttccactgcctgcgtaatcagttccacaacgtgttccacggacggcggtatcacggacggagtcagccttacggacgcgtaagaactgtttccattggttcctttcgtatgtacgacgagcctcactccgttttctgtcagctggacgtccacattttcatcgtgagtcaggatttcctcggccgggcgtttaatatccacagtgaccgacccggaattcttcatggtcggatcagacacagcgatcgtcaatacgccgtcttcatcctcttctgtcatgacagatgccgctctgctggccgccactgccccaatttctgcctgtccgtctgtccagaaattcacgcctgtcagaagtccgtctgccgttgcagcagcctggatctccggcgtattcttcaatattgtaattcccggttcttttgaataggcttccgtctcttcggcactcagcccaggaaggagaacgtattcatacgcctcattctccggattggctccgtgatcaaaccacatctccaggtaagtctccaaagcctcgcctttcgaagtcccgatcagggaccagtctcccgcgtttcttccctttctgacggataccgtctggtctcctcccgggaaatagtatccgatatcgcttccttccacattgccttccagatgggcccatgacacctcgggaattctggttcctgaaacgtcgatgctgccggccacaatatcctccagatcagcctcctgaaccggcaggtcctcggcttctccgttgaccgtcaatacattgtcttgctccggtctcagtctccggttctcaatgatgctctccaccggatatgactctccggtattggtgatccctgctcccagacacacgatctgtccgccgaacatgaaccaggactttttagccgcgaactccggggcatacggtatggaaggagatccctcgccctccttcacccggacctctccggtcatggacataccattgattccgttcgtgccgatcgtactgccgcctacccaggactctttcgaccggaaatcccctccctgggcaaagccggaactgtcaggctgtcctgtgccgatatccttggaaaccacagtcgtacctgccagccgcagcggattgaccgtattccagaaattctctgtatactgcagaacgtcacagttgtataaataggtcattccacttccctgatgccatccgtaacggttttcatggttcatgatctccgtgttctgaatgcgctcggaatacatagacagcgccagctggaaatcatccgttctgtgaacagcccggtccatcagcgccatgtttttatggactggctgtatactgtttacgatggaatcatcatctctgatttctatggccttctcttttaccgccatattctccgcaccggttaaggtatccaaaaagcccggatcgagatcaatccacgtctttaaagcgcccttcagttcttcttccacctccggggagacagaattcataagctgaatcatcagagccatggcttctcttcccgaatcacggtcactcgcccccggtctggatacagaacggcccttcaggctgtccatcatcaaaccgttgtatataccgtttaaaaaaccttctttcagataaaattccagattctcctgaacttcccttggaaaatcccacggtgattttgcaagcagcggaggaaggccgacaccgccctttaagaattcgatcccataggagccgagatacggcacatgggagtgatcgaggtaggaaccgtctgcatagaatccgctggtgtatccctggtccgcaatctttgtgctgtcttccaccgactggatgacaaacgtctccgaggctgccttggaagctaagtaaaccagttcattgtcttctcttaaaacccccagccccagcgcggttctggaacagtcgatgatattggccccctgggctgtccggtatccctgtgcatgagtgcttccggttccgatcagcccttcatgatagggatccggctggaagaagtaaagtgcttcggtataaagcgccgtttcttccagagtcagatcatcatataagagcaccagtgccggaatcagatccttcggcagaccgatttcccatgtccaccagttatcggtctgcgtcttcggcgtataacagttggaacagagccagttcagaatatgcttcatgtcgctcagcatatagctgtccttataataccggcttcccttcgccgcataggcgcttgccatggccagtacctttttaaatgccggcctgaactcgaccgcatcgtcctcatacgctatgtcagcattccccgctgctccggcatcctccggccacggaatatcctggcaggaatcctgtctgcggtatgcatacgcctcccaggcagccatggcccgctcgtcgatcgtttccagaatttcagtaccgccgtccacagctgtcaaatcggctccgatgatcgattccttccagcgtttgcggattgcagcataatcggctgagtccgcctccggcagattatccggatcctcatagagaacagttacctgccattttgcgctcgttccgtattcatccgtcgctacgatcgtcacggttcctttttcccgtgcggtgatcatgccgtacccatcggctgcccctcgaacggaggcaatgtggctgccgtctgcatcaccggcttttctgtccccgtctgtctctccttcctttagttcccgcttgattttactgcttcctgcattgcggacaaagcttccatccggctttggaatctttacttcccaccggatcgccccctgcagggattccggcgcctttattctgccatccgatccccggaccagagtaatctcttcgcccgtcaatgtatccggaacctttccctcaatggttacagtcgccgcattgcccttcatggccgcggtgtcaaacttaagtattaccttttctcccataaccgcttcctgcagcgcatccggattcgaatttgctaaaatctgtttaccagcggtctcaagaatcacctccagaatcccatcctgctgtgacggcataactgccgccgtaagttcgatgtttcctgtggaagaatccttcttcagttccagtgccgcagggtaatccatggtaacaggaacgacctgattgtccacccggacacttcccggttcccactttgtgatggctactgcgccttcccccacatcggcggccgcctggaccgcagtcgtattgataagcagtctggcatccgtctgatacaggctcttgttggaataatcatccgtcgtcccgccggcaaccagcgtatactggtacgtttcctgcggtgtgaggaacagttctgcaagctgagcggcatctgtttcctttgtattgagcctgtaataaacggattccttcgttaaataggacccgctctcaccgctgccgaatacataggaccagtccagactgttggcagctcctgatccggaagacgcgctgagccagttccgctgggtatggaccccctgagtcaccgtgtcgatcagcgatgcccacaaaccgccttctttactggctgtacgcacaagccggaatccattattcgggtttgtcagtgccagcttcgtggtgtcggtaaccggaatggtatccactatcgtcacaagcctgccgctttcttcctttcgcacctttacgcctgctcctgcacagatgatctcatcctcaaacaggaaccaggatttcaccccttctgcttcatttcccagcctgattccggtggccgcgccgctgtttaagcctgcactcatgactgcctccggtgttatctgcagcttcctaaaaccactgctgccgtcccacagcatcgtcgtccccggaaccagcgcttcgtccatggtgttccaggcctgatccggccggctgccgttaaacagtgcaagactcccgccgcctgccgatggatcgagtaccgcagcatactgtcccgtgttaaactttgactgctgttttcccgccggcagagtcaccgcagcggccggcgacgtcaccgccatctgaaatacaagacacatactgacggcctgtttccatttgtttttaccccttcgtttcacacaatcccctctttccttctataagataaaaaaattatagaaagttctgatgtaaaacgaaatggaacatttttatatttcttataaaatttcaggatttcacccgataattctattactattttcagatttttatattatttgtataaaaatactatttttagttgtgtctcatacttatatgcgtgttattgtcaatttattccacgttttgtattttcatcgattcagaatttaccgctgtgctttctttgttgtccaacagaatcacatgtttgtccaaaataccaaaagctacctcgtcctgcacctcgatcccggcctttccattggttaaatcagtcagctccgcaagcatccgttctttctgctcctccgggatcagcaccgtgagtatcacctggtctgaatactggctgtccagaatggtaatatccctctgtccaagcagatactgaagcttgccgactccattataatcggtagtgacagcagtctttaccgcaggcatcaccgagagcacggtactgtttttaagcccctcctggacagcggaagaataggcccgcaccaatccgccggttcccagcagggttccgccgaagtaacgggtaacaacagcacagacgttgcatacgccttcgccttccagcacatcaagcatgggacggccggcagtctgggaaggttctccgtcgtcactgcaccgcttctgctccccatgctctccgatgatccaggcgtagcagttatggcgcgcatcccaatactttttccgtgtctcttccaggaacagaagcgcctcctcttccgtcttgacagggcgcagagacgcaatgaatctggatttcttctccacaatttcggcggttccgccctggtataatatcttatatggatttctcataggattcctcgtttcttttttcctttccagcgtatttctttttacataattataggtaaaattccagacttaatcaagcacgttttccccactcttttttctgatccacgtataatctttgcaatttcttccaaaactggtaagtgttgaattgattttcaatctctggtataatgattcggtaaaggaggtttcctatgaactatggcaaacatgagacggagaaaaagatcaaatccgtcaattcaaaagcgaagaaatacaccagccgggtttttcttgcctttttaaagagtctgttcgtgctgtgcctgttctgcctggtagtcgccgggagtatcggatttggcatggttaaaggaatcatagacaatgctcctgacgtcgatatcgcaaccattgttccaaacgaatacgccactacggtgtatgacagtgccggcaatgtgaccgagactctcgtcaccgccggttccaaccgtgaggaggcaagctacgacgaactgcccaagaacttaatcaatgcgttcgtagcatatgaagatgcaagattctgggagcacaacggaattgatctgcgctccatcatgcgtgcggtaaaaggcgtgctgacaggcgattcctctgccggcggcggaagtaccatcacccagcagctgattaaaaacagcgtttttggcgggggaatggaaaaaagcttcggggaacggctggaacggaagatgcaggaatggtatctggccgtcaaactggacagcgccatgtcaaaagagcagatcattaccaactacttaaacacgatcaacctgggaaagaattctctgggcgtcaaggtagcggcaaggagatattttaataaagaggtgtccgacttaacgctgtccgaatgcgccgtgcttgcgggcatcacccagaacccatcaaaattcaatccggttaccggacagaaggccaactccgacaagcagaaggtcatcctgcagtatatggtggatcagggctatatctccaaggaagagcaggaggaagcgctggcggacgacgtctattccaggattcaggatgtggagatcgtcaccaaagagacttccacaccttacagctatttcacggacgagctggtggaacaggtgcaggatgccatgaaggaaaagcttggctacaccaacacccaggcccacaacatgctgtattccggcggcctctccatctatacgacacaggaccccacgattcagtccatcgtagatgaggagatcaacaaccccgacaactattcggcggcccgctattccatcgaatacagactttccgtcaccggggcagacggtaccaccacccactactccgaagagaatttgaaacgctaccaccgtgacaatggggacagcggctatgacggtctgtacgacagcgaagaaaagatacaggccgatatagacaattacaagaacagtattttaaaggaaggcgacactgtcatcggtgaatcccttcacaagacgcttcagcctcaggcctccttcgtgatcatggatcagaagacggggcaggtaaaggccatcgccggagggcgcggggaaaagaccgcgagtcttaccctaaaccgtgccagcaacacccttcgtcagcccggttccaccttcaaggtgctgactgcgtttgcccccgccatggatacgtgcggcgcgacgctgggaaccgtctattacgattcagttttcacggttggcaagaagaccttctccaactggtacagctccggttatcagggctattccagcatccgggacggtatcatctattccatgaacgtcattgcggtccgctgtctgatggagaccgttacaccgcagctcggtgtggaatacgcgaagaacttcggcatcacatcgctgactgatacggactacaacgcggctctggccctgggcggaatcaccgacggcgtgtccaacctggagatgacggcggcctatgccactatcgccaacggcggcgtctacacaaagccggtgttctttacgaagattatcgatcacgacggcaaggtgctgatcgacaacacgcctgagacccaccgcgtgttaaaagattccacggcgttcctgttgacggatgccatggcggattccatggaaagcagccgaaagtttgcccgtccgggtgccggccccagctccaccagctcgtcggccaatattcccggcatgtccaacgccggtaagagcggaacgactacttccaacaatgatatctggttcgtcggatatactccgtactacaccgccggaatctggggcggttgtgacagcaaccagaagctgaccaagcagaacggtggaacgaccttccataaggccatctggaaaaagattatgacccgtgttcacgaaggaatgtccgatcccggatttacggttccggacagcgtggagaccgcacagatctgccgtaaatccggcaaactccccgtctccggtgtctgcaccaacgatccgaggggcaacgcggtatacacggaatatttcgccaagggaactgttcccacggacgtgtgcaacaatcacgtgcgcgccacggtatgcgcggaatcccactgtctgcccaccccattctgtccggaacggacgaccgccgtattcatggcgctgccggccggcgaagaaggtaccacggacgattccgtatttgcaatgccgggctactgcccgatccacaccgaggcgtctgtcattatcccgcctacggatgacaccggactgccggagacggtagctccgggaacactgccttacgggcccggctatgtgtcgccaaacacacagaccagtccggcacctactacgggatctccgatgcaggtgagtccgggggcgcagtaagtacttttaaacaacaaaaaacactggagactatcagtccgaatcccggctgttctccagtgtttttattttcttcaaaattcatcgcctatttcatcttcggcttaaaaatcaccgaccccagatacccaaagatcagcgctcccgagatccccaccgcactggcggtgaagccgccttcaaagattcccagaagtccgtcctctcccatgctcttccacacgcccttccagagcgtgtttccgaagccgagcagtggtactgtggctccggcgcctgcccagtccgcaaacggctgatagaggcccagagcgccaagaattgttccgctcaccaccagcagcaccatgatccggcccggcatcagctttgtgttgtccatcaggatctgaaccagggcgcagattactccgcctacaagaaatgcttttacaaattccatcgttatctcctttctgccaaaggcctgttttaaccgatatgctccagcataactgcgtgtgcaatacccggaatcggctgtccctcgttaaagctgaccgtggaaagcagcgctcccgtcggtacaaacagcacccgtttccaggttccatctttaatctttgggagaatgtaggaacacagtgtggccgccgaacagccgcatccgcttccgcccgcatgggtgtcctgggtctcctggtcgtagatttcgattccgcagtccgtatggatttcctccagcaagtggtccttgttcttcataaaatcgaggagaatggtgcgtccgatttctcccaaatcccctgtgatgatcttgtcatagtacgattcatccacgccaaagtcttcaaagttctgctcgatggtatggaacgccgccggcgccattgcagctcccatgttcatggaatccttatatcccatgtccaccattcggcccgtggtaatgcctgtgatagccgcaatgccctcgcttttatgcttcgataccacgacggctccgcagcctgtcaccgtccatgtagctgaaaatggccgctggttcccgtaggccagtggaaaacggaactgcttttccgctgtcgcaaagtggctggaggccattgcgatgatcttgtccgcgtatccggcggctacggtcattgcgcccaggttcagggcctcgcccatggtggaacacgctccataaagtccgaacagcgggatttccaaatccaccgttccgaaggaggtggcgatcagctgtcccagcaaatctccggcaaacagataccggatatcctttttccggatatctcccttttcaatggccagatctgccgtctgcttctgcagcgcgctctccgcctgctcccaggtgtccgcaccaaacatgtcgtcctgctccaccacatcgaacagctttcccagaggaccttctccctccttctttcctacgatggaggccatgctttctatgaccggaggttcctcaaatttgatactcgcttttcctatctgcattctgtcattcactccatttctctgtaaaccgtatttttcaaaaaagagtactgcttcccggactcctgcaccggagcgcggccgcttaaacggccatatttcctcagcgcggcagtacgctgtttctctcttccctgctactttctccattttcctttttttctattcatccgccgcaaatcattcaccataaaccagtcataaaaggccggctgtctcacttcactcgctccaaaagaaaatgccccggcgggaccgccgggacagagactgctgataacgaagccgctttcgcttacaagactaaaaaatgcccacccaccggccgatccaatagaggatgccgaggacccagctgctcaggattccgtacaagataacaggtcctgcaatggtaaatatcttgcagccgataccgaatacctggccttccgccttgaattccacggcaggtgccaccaccgagttggcaaagcccgtgatcgggacgagggcgcctgcgccgccgaatttcacgatcttcgggtaaatgttaagccccgttaaaataacgcttcccgcgattaagaccaggagcgtccaggaggccgcggtatccttgtccatcccgctgttcatgaaccaggtgctcaccaattgtccaatggtgcagatagcgcctcccacaaggaaagccttcacgatactcagccatttgttgtggaccggtgtgacctcttttacataggcatcgtatgcctgtttgttaatctccatattttacctccgattcctgttatctactgtccgaaattgcctgtgaaatatacgagtgaacctatgagcttgccaagaccgatggccaggatcacgtactgaagtcccacggccagatgaattctcctgctgataaccggcagggcctttaaagtctccgccagagacatgacgaggcagccgacaaagattccgaccgccagcccatagatccccaggaacacattcccgcccatgtggatcgggatctcatagatatcggatacgtttcccagtacaccgcctataataatgaccgtctcatacagaaaaatgtgtttatttgtatgggtctttccaatcagccgcggaaaaacgccgatgattgccagaaatgcaaaaacgccggctgctatgacgccgccggcgctaagccccagaaacacgagaaataactgcttaagaaacatcaatgtcctgctcctttctgccgtcattctgaatcagggtcttgctgacattgtcctcgtaaaggcgcatttccacctccagcggtgtcggatccgtattgatcttgaacttcgcaaaatggttaaagaatcctacgatccccagcgccagtcctacggaatagctcacctccaggatcgtgaatccggtggattcctttcccatgatgatccggtaaatctcgctgaagacatccgtcacactgacatcgttattaaaggtcatgatggcaaaggacgcgccgcagaaacagataatacagacaaatatggtcttgatccattcccaggcccaattcggggacttcggccggtggtaatcgatgataaaatccacttcacccacattattgacggtgatcgtcggatccatctccgtgatcttcttaatcacatccagcgtgctctccacgtaacgtttatctctgtccaaatgaatcgttttaatgcgcagggcgctgcacttgtttgttacggcggaatcatcgctgtagaccgtcgccacatcctttaactgaatctccttatgatggacctcagtaatctggctgatgtttagatagacagtcttgctcatattctcatctgccccgctttccggatgagttctaccagcgttccatccatttcgccgccgtccggcaccgcggcgattaagtaccatacaatggcggccacagcgatcaggcatacgacaaggagtgcaattcccagcttatgtttcatggattccatacgtgctcacatccttttctttcacttttcatgagtagtatgagccgtatgaagtattttattctatattttttcgcgcatctgctttaaaatctttttttcaagacgggaaacctggacctgtgaaataccgagacgcgttgcaatctggctctgggtttcattataataatacctcctgacaatgatttcccggtccttatcggagagctctgtcagcagctcccgcagcaccatacggtttagcagttcctcctgggcagagttttcctcctcgatcttgtcgatgagcagaatgctgttttcatcatttttattgaccgtccggtagagcgattccacctccgctccggcctcgatggacgccgccacttcctccttgctggccccgatctctccggcaatctcttcgatggtcggttcccgtccaagggtaaagtttaaggcctctctgacacattttacacgggtgcccatctccttgatggagcggctgaccttaatcatgccgtcatctcttaaaaagcgcttgatctctcctgttatcatggggaccgcataggtggagaatttaacctcgaaagacatgtcgaacttgtcgatggccttcatgaggccgatgcttcctatctgaaataaatcctccggatcatatccccgtcctgtaaatcttcgcacaatgctccagatcagtcccatattctcggtgacgagacggtcgcgtgcttctttatctccttcgtgagccatttctattaatctcatggtctcatccataggactcacccgttaatcttctttttcatggtcacaacggtacccttgtccggttctgactccacacgcacctcgtccataaacgcttccataaaggagaatcccatgccggatcgttctccctctggatcggtggtaaacatcggttccatcgcctgcacaatattgggaatcccgattcccgtatccctcacagtcacggtcagctcctgtttcagtatctccacctcgagatagatgatcccgccgtttccctgataaccatgtatcaccgcattcgtcacagcttccgacaccgcggtctttacgtcgtccaactcctccagcgtcggattcatccgagccataaatacggacaccacaacccttgcaaactcttcgttccgggacaggctctcaatttccattctcaaaacttctggtctgttttcttctaacatgtcttcctcctcaacctgtgactgcatcttcctttgagtcatataatttcattaattttaaaatgccgcccattttcagtattctgagcacctgggctcccgctccgtagatcgtcacctttcctccgctccgggccatctgcttgtatcggtttaacaacactccaatccctgaagaatccataaatccggttcccgagaaatcaaacacaatgcggttaatataattttccgaaaggatcagatcggtttcatattttaagccggtgcagttgtggtgatccaactcctccggcaggtggacaatcagcacatggccgtccgcctcataggtaaatagtggcttgttcataattctcctttccaaaaagaatcccgcttgccggactctttgttctatcgcagagctcttttttatagcaagaaagagtccggctcgccggactctcgcgccggagtacggctgcttcagcaatcatacttccttagcgcggagtgcgcatcctgccctaaaggctttttatgtaacaggagcactttcctgctgcacaaaaaaagacacggcaaaagagctctctttctcttctgtcgtgtcttcctttttacgcaaggcagtactagaatccccgttccgtcctggcctgcgctatcaatgtttcatctttgctgttatttatgatgtccgtaaacatctcattcgcctgttccttctgattcattcccttgtaaatgacggccgccttatacttggcagcccagtaatccggcttcacagccaggctctttaaatagtaatccagagccgtctggctgtctcccgcgcccgaagcctcgtctccaaggctttccagcacctgatatccccgttcctccatgtcggccttaatctctccgacgatggccagcacatccggtgacgcgatgagttccgtcttcaaatcggcgtaaagctttaccgccgcggtgaaatcatcctttttatacgcctgcagaattccgatcacgttctggtattgagccagcacgctgtccgagtcattggtaaatgtggacagggaatcttccgccgttttcttatctgcctccaggccggcgatctgatcacttaagctgtccgccttctgattcgcctggcttaagctctcgctgtacttaagcatctcctggttatgtttttcattgatcgccctcgtattcgccggcataaccaggaaaaagacgaccgccgcccccaaaagcaggcccgcgaggatattgacgaccgccatatccttcgtattctctctgtagctgggcggaatgatgacatcgtcatcctccatctgccggtgggacaggacatttttcagtttcctcttttcaggctcacgctcggtgcggcttcctgtattcgccttgacgatcgacttataccagagcgccttcgggtgattcctgtctatctgtaataccttgtagactgattttcctgccttctggtaatcctctctcgcaatacagagaatagccagcagcagctgggccttcacgtagttcggcttcgcctccaccaccttgacgagctgaaggatcgccaagtcctcgctgccgttctgggcgtagacgagggcctggttaaacctccggatcatgtggcgctccgtgtcgagactccccttttttctctggatttcacccagatagtagtccgcccggttctcctgcggctgcaggttcatgctgatgacccactgaacaagcgcatccccaacctccccgacctcatagtaaataaggcccagaaggttcctggcatccgtctgatacttattaaaatgtaggctcttctttaaacattcggccgcgccggacaaatcccgcagccgcgcccgctctaatcccatgttataatagctgttggcaatgacacgggtttttcttacataatccatatcttacctgcctattccttgccgacttccttgatcagttccatcatcaaatcattcatatccgtcagatcgcttctcacgatcgcatcctctatggcatctacttccagactcggtctgtaatcgtttatctcggtttcaaaatcaatcatcttttatacctccaagaattgtctttatctctcccatcagatacagggatcccacgcagaacagcagatgttccccatcctgccatgtgagcagtgccttcagtgcttcttctgccgtatcaaaaccatatattctgcaatcggaaacggctaaaaactccgcctccagcacttccttcgccattccccgatccgaatggatatgggctaccgcaaccgaatccagcggcagacccgccgcgatctcatggatcatggtatcgtgggccttgtccgataccgaggaaaacagaagacaggcccgcttcccgctcttctcacagaggcgcgcggctgtcttgataaattcttcgattccgcctggattgtgcgctccatccaggtacagcccgggcgccgcctcttccatgcgcgccggccatctcatggactccagtccggccttaagctcctcttctgataagcgtatatcttccctctgccgcatcagtacttccaccgtcctgagtgcagtcagagcgttcatcacctgatattccgcctgggatggaatcagcacgcggagaacgctgccgtcaagccgcttaagtcccgcccggattccctgctcttcccatgcctctatcacatagtcctgcctgtccaccggatatagcgggctgtggctggcagcggcctcttcctcgatcacagcggctgtcccctggtcgcctctctcatatatcacgggaacgcccggctttatgataccggccttctgataagcgatcttttccacggtatcgcctaaatattccgtatgatccagacttatggaagtgatgaccactgccagcggatgacggatcacattcgtcgtgtccagccttccgccgagtcccgtctccagaaccgtgaaatcattgcccatctggtcaaacagcttcatacccatgtaaaacaggaattcaaaataggatggatggcagtatccctcttccgtcatgcgttccgataaatccctgatttcacgaaagctgctctcaaacggcccatattcgaccggcttaccgtcgaataaaaacctctcccgcacctcggtcagatgaggcgagataaatgctcccgtgtggtatccccctgccatcagcatggaggttatatatgcacagaccgaaccctttccattggtcccggccacatgaatgatctttctcttctcgtcggggttgtccatccgctccagaaaagccctgatatcttccagggaattcttttttctggcccacatggggatatcggccagatattcttccgcagttttttccaaactcatcttacgccccggctttcgttctttatgtaatcttaatccttatgctgccttactgcgcgccttttcccgcacgccaattcgggctttcttatttattataatataactcggccattatgcaacctctttctttcgcaaatacagacggatttctacatttttactctggttctttcacggaaacgcggacaaagcgccgggacaaacgctcctgtaaaacgaaaaacaggggtattccggaaccacaatccgggacacccctgttatcatctgtcaatttattctccgcagtatgcgatcgcttcgatctcaacaagcgctgcctttggaagagcagctacttcaaatgcagctctggccgggcatgcaccctcgaaaaaggttgcgtacacttcgttcatagcgccgaagtcgccgatgttctgtaataatacagttgtctttaccacatttgccatagataagccttcgctctctaagatcgccttgatattggttaaggactgcttcgtctgggaggcgatatcctcgcctgcaaatgctcctgttgccggatcgatcggaagctggccggatacgtatacgtaatctccgcctctcactgcctgggaatatggtccgatcgctgccggtgctttttctgtagccaatacttttttcattctatgtatctcctttcgttcttcacgttatatatctagattatcacacattccgcaaaagtcaagaaagttttttaggttatcttaaaaatatttagtttacctgtttttcttttcgtttatttacctcttgtcatctagtattgaatactatataataggatatgaggtgaaactatgaagacgaatgacgaaagaatacaggatatcctaaaacgtctggataccttaagttatatcaggcccgaagagattccgggcattgatctttacatggaccaggttactacatttatggatgaacatctgaagaacacgaagcgctaccccgaggataaggtgctgacgaaaaccatgatcaacaactatgccaagaacaacctgctgcctgcgcccaacaaaaagaagtattccagagagcatatcctgcttctgatttttatctattattttaagaatattctttccatcaacgacatcgaagaattgttccggccgatcaccaccggacatttcgcattgaaggacggccttttactggaggacatctacaaagagatcttctccctggaatcggaggagatggaacatttgcgggaagacgtgaaagcaaagtatgaacgtgcgggcgatacatttacggacgagaacctggctgaggaagacagggaatacttacggctcttcgccttaatctgcgagttatcctttgacgtctatttaaagaagcagatggtggaacagatgatcgacgagcttcgggaagcgaacccgtccaaaaagaaaaagtaagtaagcgaagataaaacgctccctttcatgggaacagtcccctgcggaatctgttcccatgaaagggagcgttgcatttatctctccattttgtctgaagctgcggcctctccgggctgcactagtactagttcgcctctgtatcctccagacgcttaaataccatatcatatccgtcgtttccataattcagggaacggttcacacggctgatcgtggctgtggaagccccggtcttttccgcaatctccagatacgtgcggccctcgcgaagcatcttggctacctcataccgctgagataagctgagcagttcgttgaccgtacacacatcctcaaagaacgtatagcactcttccggtgtcttcagtgtcagtattgcctgaaacagatggtcaaccgcatctgtcttaatttttttattcatggtttcaatcagtcccctttatttttgctgttacttcatctatggagtattttaacatattaaagtcataaagtccacccccggacacttatgacagcataaatttttcgatgacatgagcaacgccgtcgtcgttgttggaaagcgtcacgtaatccgccgcatttttcacgggcaggaccgcgttctccatagccacgcccagaccggcatactgaatcatggacaaatcgttgtatccgtcaccgcaggcgatcatctcgtccttcgtcatgttaaggcgcgtaagcagccgctctaaagacgccgctttatcgattcccttgggcagaacctccagaaagtggggttccgaacggtacacactgtaatcacgccccagtgcggccttcaccttcggttccacgagagccaggtaatccccgtcgtcgagaagcagaaactttaccaccgggaaatccacgtattgctcgaagttttccacccgccggacctccagtttattgatgtcggactccttttttacatagatatctccggggtccggcgtaatgatgcagtccccttcgtatgtaaggatgttcacgccgtgctccctggccagcgcaatgatccttttattcgatgttacaggaagctcctttgcaaacacggtctcacccgttttgcattcgataatacgccctccgttgaaggacaggatataaccgccatcctctgtgagtcccagctccttcgccagcggcatcaccccgtaggtaggccgtccggaggccagcacgatggttcccccctggcttttcagcttcatcagcgcttccttcgtcctcggtgtgatcactttatcccggtttgtcagtgtgccatccagatccagcacgatcattcgatatgccataattccttctcctgctttcgtaaaattctccgtgaaaagtatatcatacttcggggtaaaatgcaaaatttagaaattcgactcataatccgggaactgctgcctgtcacatttcatacaatgtcactatgagaaacaacaaaaaaggagaattctatgaaaaaaatcgtgagcatcgttctcgccgtatccatgcttgccgtctgcgtgaccggctgtaaaacgaccacaaggaaacagcttaagccagtggttctgaatgaagtcgctcattctatcttctatgctccccagtatgccgccattgaactggggtattttgaggatgaagggctcgacctgacgctggtcaacggcgccggcgccgacaaggtcatgaccgccctgatctccggagacgccgatatcggttttatgggatctgaggccagcatctacgtctatcagcagggttctgacgattacgccgtaaacttcgcccagctgacccagcgggccggtaactttctggtcggcagggaagcccaggataacttcacctgggccgatttgaagggcaagaaggtgttgggcggaagagccggcggcatgccggaaatggtatttgaatacattttgaagaagaacgggatcgatcccgccgcagatctgaccatcgaccagagcatcaacttcggtttaaccgccgccgccttcaccagcaacgacgccgattacacggttgagtttgaaccatttgctaccggtctggaaaaagaaggaaacggccacgtcatcgcctccctcggcgtcgattccggatacgttccctataccgcttacagcgtcaagaagagctatttagagaagaatcccgaaaccatccagaaattcaccaatgcgattcagaaaggcctggaatacgtaaacacccattccgccgaagaaatcgccaaagtgatccagcctcagtttaaagaaaccgatgaggataccatcgccaccatcgttggccgctataaagatcaggacacctggaaaggcgacaccgtcttcgaaaaagacagtttcgaacttctggaaaacatcctggaggaagccggcgaactgaatgagcgcgttccttacgacaagctggtaacaaccgaattctcacaggaagcggcaaagtaaaaccgaatgcccacacataacaaacagatcccgtttccgctcttcaccgtcggaaccgggatctgttcttttcacatccttatttatcttttcacaactctatttgtcttttcgcatatctcttttttcatacatggccgtatcagtcaaataccaccatacatttcaaagtctcctctgcgtcaatcacatagatcacttcattctcccaggcgtacgcccctttgatcttcaggatctcaccgatccggtccggcgtatctcctgtcagccgcgcgtctgccggtacccttaagatctccggttcctccctcaccaggaagccgcactgcagggctcccgtctccgttattatgactaccggctggtctccgtacccgctctcttttgttcctgtcatccggcttaaagaagcggcggtaataatcgtccctttccagttgcacagcccttcatagtagtccggcacacaggggaccggggtgatacggctgtcccatatgatctcccggatatggggaagttcgaatccgtagaccgcatccgtcatgcggacgcacagaaattccagttcctctccgccttccttctctttcgcctgatccaagtcattcatgggtctttccacctcccgtattccgcgccaggtcttcgatatccagctgaaggcagatggttccgtcccccagcaggctgcacccggagattcccgtatacttcttaaaatgctttcctaaaatggccgggagcgatttctccacaagactgccctgatctgccacccggtcagccacgatgcagagctctctcgtactgcccttgatatacgccatgatttccgaaccgatcctgggtgttcccggaatatggtagaacttccgcagggaaatgacgggaatataccgcccctccctgatccagaactctcttccttcccgcatcaccattcccggcccctgcggctggtaggtgacaaactgaaccacctggtgtgccggaaccgcgaagaaccggtctccggtctgaaaacggatgctctcaatgatcgtaagcgtcagtggcagatgcatgatgaatttgctgccttcccctctggtactctccagatgaagatggccgccgaacgcctccaccatctgacgtaccacatcgagccccacgcctcttcccgagtactcgttagccgcctcccgcgtcgaaaagccgggcagaaggcagaactctaagatctccgactcggaatactccgattccggccgcacgaacagattcttttctctgccctttttgcggacctgttccaaatcgatgccgcatccgtcgtcgctgacactgaccacgatctctccgccaacattggcaaacagcagtgtcaccgagcccgcccgcggttttcccgccttctcccgctcttccggctgctcgattccatggtcaatggcgttacggatcagatggagaagcggatccagaatgccatccgcaatcttcttatccacctccacattctgcccctggacgtggaaagacacctctttcttttccttcttgcagatgtcgcggacgatcctgcctaactggggcaccacattggaaaacggcaccatccgaatcgatatgaccagttcctccagctcctttaaaaaacggccaacctgatggttcctgccgtcctccacgctccctttcgaggcttccagccaggaggacgccgcgataatcagttctcccgtcagattctgaagctcatccagcttttccacccggacattgataaaatcattgccgttctgcacaggagtctcggcttcggtctccggttcctttgcagtctgaccttccaccgcctgtccctccgccgtcccggacagcttcggcatctccgccagctccgtacaggactccacaaacagcgcgctcttaagcgtctgtaagactgcgccagggtcttccgacgtaaagctgatataaaaaccattattatgaatatattccgttgtagaggaatccgtctccacattttcgggatatgtctttaaatccgcacataaatcccggatctggcgtaccgccatgtaggcccggacattctccatccggcagtccttttcaaatttcagatggacggcagtcttctttttttcttttaccttctgtacgagaacctctattttatcccagaaccggtccaccggctccggctcgaagctttcgaatttcattcgtttcagttcttcccggatgaaatcagtggcttcgaagattaaatcaaatgtctcctgttcataaccggaaagcctggaagggtcttcccgaaacaccacaaacaagtcttccaggcggtgggtcagagtggacaatccggtcagccccatcatggcggaagaactctttatggtgtgcattacacgaaagatgccgttgatactctctttggagaataccatctcctgctccgccgagagcagaatggcatccgactggtccagaagctggttggtctccagtaagtagatctccagcatctcgcccgtgtcctcatcaaaaaagcccatacccatcacactcccgactcttcctcataaccataccagacggtacggttttttcccgttttctttccgcggtaaagcgccatatccgcgtgcgtcatgttcatcttaaagctctgttccttatcgtaaaggctgatccccagcgtcacggtgcagtaaaatgtggtattgccctgaagaaaaggaaacgcctgaatttcttttctgatctcctcgcagacttcaaaacactcctgttttgtgactgccatcagaataatcaggaattcctctccgccccagcggaccaccttatggcggcggcagacgctctccataatattggaaatacagacgagaaccatgtctccggcgtcatgcccgtagcagtcgtttacgtgtttgaaatcgtccacgtcgatcatgaccagtgcatcctggcgattcggttccatcaaatcctgagccagcttctccaccacaaaccgccggttgtaaagacctgtcagctcgtcccggtaagccacgcggtttaagatctgcatgttggccttcagcgtctcatttaagatcttcagctcgtctctttcccgcttgtcctcaagatgcgccttcaccctggatttcagttcttccggccggaacggttttttaatataatcacaggcgcccagttcaaatccccggattacatcctgttcactgtctttggaggtgataaagatcactggagcgtgattcttatccttttcttttatcttttcaaacagttcatacccctccatatcaggcaaaatgacatcgaggagaatcaaatcaggatccacttcctccagtaactccagagtctccttcgctgaatgggatttataaaccgtatattcctcattttttaaaaccttttctatctgctggcatatcagcaggctgtcatcgaccgccagtatcttctgtctgcctgtcatgctttttctccttccaaccgccatgttctaccctatatcaccgtaatgcctgcactcattgacttgactgtcaggccgccatccaccgaatcaaacgtgatcgtcctgccgtagttcttaccggtatcctccgccgtcacactcaccttcagcgcccctaaaacagcttttaccgcctttacattgcgttcccctatgcttccgagggcttcgtatttggagaacatccccgcgcctcccgccagcttcgccgtgataaagcggcggttcgccccctggagctccatctcttttatgagctgctcacagcccttatccgcgaatttgtagggattttcctgagacaggctcagtcctgcatccggaagcataatatgtgccattcccgcaatacggtgtttctcatcgtataaacagactcccacacaggaaccaagcgcataagtaatgagtttttccggccgggaaactacttttccctgcgcgattcccaccactacaggattatccttcatattcctcacccaaagccttgaaaatccgctccagagagtgaatctccggaaggaacagaatgtggctgaccacttcctgatcgtcaaaatggtatttatcctcgatcagaagcagttcatcactcagtctcgcaaagtgaatcatcggaacgcttaatatagctccggtcatatcgatacagatgtccgggacggaaacgtgaaccctcaaatccatcatcaccgtcatcgcgttaatataggaacagcacatgatattgccgatctcgcagaccgcggaaagactcatatcatccaggttcctgacatcctcggcctctgttcccaacagcttgtcaagcatggtctgggcgaacttcgtgctgatcaggaacataaacatgccgttcaaatcgccggagagctccaggagcactcccagcttgatctcctccggaccgcccagcatggcgggtacttcctcgaatttcatgattttcacattaggacgctcgatctcaatcctgtggttaatcatgctggagagcgcggtgaccgcgtttcccgttccgatattaccgatttccattaaaacatctctcgcgctctcactgatatccgaatatttattcatctcatacctccgcagacgatggaaatgcccggttaagggcctggacgatttgctccgccttaaacggcttgacaataaagtccctggctccgcagtccacggcttccttcatcatggaatcctggccgattgcggaacacataatcacgaaggcgttctcgtcggtctctttcatctgttttaatgcttcaattccgttaatgccaggcatggaaatgtccagaagcaccagacccggccttatttttttgtacagcgcaaccgcctcttctccgtcggccgcctcatatacctcgtaatccccggatccggctataatacgtttctgcatggaacgcataaacacggcatcatctacaatcagcactttcttctcactcatgacagctcaaattcctccactaattttttcaatacctgtgcctgcgccgacagttcttcactggaagcggcgctctcctccgcagtagcggaatttccctgtacaatctcagacaccatctccatgctctgtctgatctggataatggaatcggcctggcgcacagaggcaccggagatccgatccaccatggtaccgatcacttccgtgcccttcaccaccagatccagcgctctggccgtcttatccgcggcctcggtgccgccgtccactttttccgtggtctgcgccgccagccgggccatcatcccggaggcttccctcgtcttcgccgcaaggtgacgcacctcggacgctactacagaaaatccccggcccgcttctccggctcttgccgcctctaccgaagcgttcagtgccagtatattcgtctggaacgcgatatcctcaatctcctttacgatgcctccgattgcgctggagttctcccggatttcaaggatcgcctgaaccatggccttcatctcgtcactgcttctggtgaccagtccgcttacctcgtccacctttttgctggtcattacggcgtcattggcgttgctcttaacgctgtccgatatctcgttgatattggccgccagttcctccatggagccagcctgctccgtggctccctgggaaaggatctgggcgccgtttgcaacctgctcggagcctcccgccacctgatctgccgtacaggcaatctgcatgatcgcacggtttaaaagtcctgtaatctgctccatcgcatcacccagtgcgacgaaatcgcctttaaacgcagtttccggatggtagttcagctttccgttgccaaccgccaaaagcccctcttccactgcggacacataatcgttcaaagcgcttatggtctcgcggaagctgtccgccagctctcccagttcatcctctgactggtatttcagctgaaccttaagattcccttccgccaggttctttgcagcctcccggacctcactgacaggttctgtaattccctttgtgatatagagacacagagccacggttatcatcaggataagaaacgataacaccaggattactgctgtcatctgctgccttacctcatggcccctgtcaaggtatttctccgcattaaccctggaataagcggtaatcgcttccaggcattccctcgtcttctccgctttcggctcgaagtcactgccatataaagaaatcgcttcctcgtcgctgccgtttttcagttcctcaataacggcttccctggactgcttctgatcttttaaagactcccgcagctggttcaccagatcgttatccggcatctgttctttcagcatggttaaattcgtatccatatcgcgcaggatctcatcgatctcatccagctgctcctgccggtccacattcgtcccctctgtggcaatactcaggattgtacggccgatactctgaacggatgcccttaagtttcccgccgtataggacgcagtgaacgccttattgtagaagacatccagtgattttgaaacattgtatactccaaacagagagacgatcacggttatgatataaaaaatgataataataccataagaaaccatgagcttctttcctattttcatattcttcattttcctcatcagttctttccttccgcctgtcattttagatccagtatctggaacggtttaccgtttcaatctcaagccttccgctgccggccataaagtgaacgctccgtccataattttcccctgtgtcctccgagacaatcgccaggtccagttcctgcagcatctttctcgcgcagctgacattctccctgccgatatccggctgccccgcctgtccggcaaagcagaaaatcttcgctcctccgaccagctttacccggatccgttccggtaccgcgccggcttccttcatggcctcaaacagcgcccgggtcgccgtgtctacataccgcagaccatttttcccattgccttccctccgtatgtccggaagcagagtgtgtaccagtcctccgataccgccctcttcatcatacatacagacagccaggctcgatcccagcgccatggtgatgagaaccgcttcccctttcgctaccgccatctgatcaggttttatcacgatctcgctcatccgctcacctccaccgctttcataatctctgagatggagtcttcacgaagaaccatgagcatacagcttttctgttccgcctctgcggttgaaaagttattgccaatgcagattccgccgggaaatgtcccggccgcagtcccgatcagcgccgtgataatagctcctgtcatgtccatggagacagcggagtcagacagcgtgatcctcagtccgacacaggccgagagcccggtcagataggaagaagccataatattggccgtctccttgagcagatccagcatctgtccatccatctccccggacacctgctccgtgttcagcagtttcctgagaattacgtccgtcatctcttctttgtatatctgaagaagcatgccgttaatatcgccggtaaatggaatcagaacggccgccacgttttcttctgcatagccgatccattccgccagcccgtcataatcaaccgtcttcatgacaggaggggcgtaacacaccttttctccgatgatatgggataaagaggccatgctgcttccggttccgatattccccatttccagcaatgtttctgccgccggtccgcccggcagctccctttcgtccttcatttctccctcctacaaacacgcttttacgattttcaagatctcctcgtccttaaatggcttgataatgaagtcggaggcgccgcagcggatcgcctccgcaatcacctgctcctgtcccaccgccgagcacatgatgacctttgcattccttttaaacgcaagaatatcattcagcacttccagtcctgatcttccgggcatcgtaatgtccagaagcatcagatccggctgcacctccttatatttctccaccgcttccacgccgtcgcccgcttccacaaagttgtcgtaccctccctgggtcagcgcgcgcttaatcactcttctcataaacatcgcatcatctgctatcattatcaatggcttttccatggcctacctcccggttttattattcatattcatgcagaacctggttatctctccgctgatcaggccaagtcccatctgtctttccgctccgccgtttcgaaaggccgattccggcatggagtaaatctcactcgtctctttatcctgtgcaacggtgcgggctcccgcctggcgcatggccagcagccctttggcgccatcctcccccatacctgtgagaataatccccatggctttctccttcaccgtttccgcaacggagttcatggtgtaactgatggaagggcagaatccgccgtaccgtttccccggaacacagcgaatcatgaagccgtcctccagttttcccagcgacatctgatatccgtccggggcaatatagaccgtgccgtcgcagaccggctcacccggctgcgcctctttcacgcgcatcttgcactggggatttaaatactccgcaaatttaccggaaaagccgtggcttaaatgctggatcaccaggatcccgcaggtggtcgatggcagctccttaaggaccgtgagtacggctttcggaccgcctgccgaagccccgatcaccgctaaatatctgcttttcttttccgtctgaccatccactgactcttcccccctccgtcatcaggcgcgcagcggcctctatttcctgtagacagccggacacacgtactcaaacagttcatggtttctgggcaataattccgtatgccccacaaacagataaccgccgggctttaaagcccggtacagcttctcaatcaatttctttcttgactcctcattaaaatatatcatgacattgcggcacagcaccagatcatactgtcccagccccacgcttggtttcaacagattcatccgctgaaaccggactttctctcttatagcgcggccgatgtcaaacgaagttcccgcctcgtccatggatagatatttctgctgccacaatgccggaatattctccagctcccggaccgggtatctccccttctgggccacggccagcgcctgctccgaaatatccgttcccacaatggagaaggatgggagccacccgccctgatccttatagtcctgcaaaagcatcgccagcgtgtagcactcttcgccgctggagcagccagcgcaccagatctgatacgatatgcgcccccattccggcttaatattgggaagtatcttttcccgcaggaaatcgaaatgcttcggctccctcataaaatatgtatagttggtggtcaggcggtttaacaggatgctctccagctgtttagtcctgtccatctccatctgtctcatgtactctcccatggagatgtttccgcgtttttccagttccccgttcattctgcattccgccagaattttcttctttgacagatcaattccgtactgtccggacatataggtaatcagctgtgtgaactcctcattcgtaaaccgtatcaatcgcgccccctccggcaacctcatcagccgccattccctttaagctaccgtcttcttttcttatcagtacgacacacgccggagcttcctccggcgccaggttctggttcttgcctgtgatctggtcgtttaccggcttttggtcgtttcccggccggaacacgggaatcagtccgccctctttatagatcatgcctacaagattatcaggcgcccccggcacccttatgatttcagggcacggaagaatcagttccacccgttccatggctgtcacttcgcactcgccgccataatacaggcgcagcatctctctgccaattccttcctgttccatgtgtgcccctcctttccttcagtcagccatcagatccgtaaattccccgatgggcgcaggtctcccgtatcggtaaccctgagccagattgcatccgatctccgtcagaaacgcctcatgctcggccgtctcgattccttctgaaatcacctgaatatccagctcatgggccagatgaatcacgttggcgatgatgatcttctcccggtcgcttaagcgcttctggaagaattctttatccagcttgataatatcgacgggcagatccttcagaaggctcagtgacgagtagcccgttccgaaatcgtccatggacaggacgaagcctctttctttgatccgccgcgccacctccaggatttctcccggattgtttaaaaatgcactctctgtaatctccagctccagataccggctctccacaccgtatttgccggcaatctgttccagttcctccaaaaagtcaggcttcgtcaaatggatcctggatatattcactgcgatgggatacggcgttctgccgctgtccttccagctcttaatcagtctgcaaacccgctcaaacacatataaatcaagctctgtaataaatccgtttttttcaaacagcgggataaattcgtcgggcggaatcatctggccctccatcatcttccagcgcacaagggcttcgaacccgatacagcgcttacggggcagatccaccttgggctggtaatagacgacaaactcctcattctccgccgcgcgtttcatgcggaatgcaagctcccgttcctttgcgaatttgcgctccgcctccctgttgtagaagctgtagatactcttatggtaatcctttaacgcctttctggccatgttggcatggtctaccaggatagacatctccgtgtctcccggttccaccaggcagacgcccatgatgcagctgatcgggaagtccttcttctcctcccgcggaatctgttccacccgccgcagcagctggtccagacggtgctgcaggccattaacggtctggtattccagaagcagcgcaaatttatcggcttcaattctggcaaagcactccccgccgcccgtaaaattactgagcagagaactgatgcccaccagaatatcgtttcctgtctcataactgtaattcgcgttaatcaccttgaaattcttgatatccatggtgactatcgcctgtaacagcggcgcgttcttcagccgctttcttccctcgcttaaaaagcggttgtaattccatgcctccgtcagccggtcgtgatccatcagaatctgcgtaaaacgctgaaaacggcgttccagaatacaggcggccataacacgcccagccagagcgaaggtcatgctctcctccagcgtccagagcctttcttttttattatcattcacactgatatatccgatatagtccccattttccatgatcgggaactgcatcagggatctcgtttttctcagcttctggcgttccgcgatgaccggatccagaatctccagttcgcagatccggttgcaggccagcaccttccggttccggaaaagctccagataccgttctgcaatgagtcccggtattatctttaaattatcgttgcggaccatcggctcctcttccatccagaaagaggtaatctcatagtccttccctccggatttgcgctccagaatataggcctcaccgcatccataataggcacagatccgtttcaatcccatttcgatggggcattcctgttttccgggcagaaaatgatccataattttgcggataaaatccatgtcggcttttccgctgtcctctatgtactcaggtatggggcggatcgaatacgcaagatctgtttccgcgtcccccgtctccatttttccgcacacctctgtaaaacagaggaacttctcctcctgcttcgcacgcgccagcgccgcctttgccctctttaacagagagtcgtaagtctgtccctgtccgtctgtcagcgcacctcccgccgtcatgtgcagatccgtttcccgctccaggctggtacggacactgttcatggaagagaccgcatcttcccggctgcggcatcccagaagaaagacaagaaagcagttttcgcccactctcgccacaagatccgtccgcctcagggtacactgcaaaaggaaggccgcctgcttcacagaggcctccggaagtttcgtcccgccgtttgccgcctccagaagaaaaaggccgtcgcctccccagttctccgcttccttcaagtattcattaatcatcacttcagccgccgcttctgtccacgtattggtcagacggtccagccgtttttctctgtttgaaaccatgacccgttcaattcctctctttattaagaaaccgttctatatccatcacgaaggcccagcatccggaggaatcaagatacaccgcctgcgtcaaaaaatcattcttctctccggttacatcctcaggaagctcaaatattctgtcgtccgggacttcaaatacgccggccacacggtcagccaaaagggccggaagaccgtcttccacctccagaaggaccgcatactcccgttcccggttgtccccccacgaagctccaaccgaataaatctcagcctcacatccgttaaatgtaatcgtcttctcctgtcccgcatttccctgaacaatatggcgtaccagcttcagcggaatcaaaaaaaaagcgccctctgactcaaaacataaaaatgtttccatcataaggcacctccttcgcatctttcacatttgtatatactatttactatattaacgtataatgcatgaaaaagcaaggttattacacctcttttgcttccagcatccaaccttccagactgagtttgaaacgcttccggaacaggtgtgaaatccaccagaccgaaacaacagccaccgccgccatcaccagcaaaaatgtcccgaaatccatccatctgccataggatgtcacaaacaccagggaaaccagaatcgtcaaaatactgaccaccgcgatcttccgttccacacgcatcttctcccatcggttcttgaccagacgttctttccgcttttcctccggctccggaccggacagttctgcctttactccgtttaaggtttcctcatatatctttctggcatccttttcgtagtaatcagaacaatttttctttatctctcttaatccgttccatatgattttcataatatcctttgccgacgtaaacatgtccaccctcctttttttctatcatacaacaaaatgccataaaaaggaataaaaagtaggtcatctggtaaataattccatgatgtcccagtcatactgcatatttccattttgatggccatattaatatagaaatcctgttttatggagccaatatgcagaccattacccaaagagtactgtcggataccgtatacagcaaagggactgccgtactcacttatacgatccgttatccttacttcaccacaacctgctccgaggcagccgccttaagtatcaatgcgttttattccaccgccgcccgaaagacggaggagtactgccgcacagtcctggcttcccaggcctccgttcaggcagaatacgcaaagaaagacaactatccgtttttcggatatgagttcataagtgcttataccgtcacctggaattccggatgcatgacaagcctctacaccgatcagtatacctatacgggaggtgcacacggaagcacgatccggacctcggatacctgggatttcagcagcggcagttacttgacgctggccgatttctatccccacaatccagcttaccgggaaggcatcttccggattctggatcagcaggtaaaggcgcgggagaaggactcgccttccacttattttgacgattacccggctctgattcgatccaccttcaaaccggagagcttctttgtaacacccaaagggattgtcatctatttccagcaatacgacatcgccccctactcaaccggaatccccgaatttttgattccatttaaaaatagccggtaatgcccgtaatagcaggcaaaacggaactttttccaggcggatctcttccaactggttccactttttaatttttctttcaatttccacttgcaaattctgccaaaaagtgttattatatgattcgttcgcttctaagcgtatcatatcgaggcgtggctcagtttggtagagcgctgcgttcgggacgcagaggtcgcaagttcgaatcttgtcgcctcgatgataaaaagtgcaggatatctttcatagaaatcctgcactttttttattttctactattcttttttctattccattttagtttcatccggctccattgcaggctaaaatttcaaaaatcggaaaaatcagaaaaaaagtgtaaattagtgattgcaaattttttatctttttgctataatagcggacatgggggtatagctcagctgggagagcgcttgaatggcattcaagaggtcatgggttcgaatcccactatctccatgagtcatatgctggaagtcttgatcgtacaaggtttccagcatattttttgtttaaatgcagtatttattccactttgtcctgctcttcaccgatatatggaggtaacgccaatgccgcatcacagaaagaaaaccatcgatcaaatgctgaatgaacacagctctgaacaggaatacggttcctgcctggactgcggcgatgacgcctgctgcgaatacgatcaggtcacaaacgtctatgtattttcctgccataacgaggattgtccgcaccactggccgccctgtaacacgccgcgtatcgaagatgctccggactggttcgcctggcccaagccgtagtaaggccgtcttaggtcctcggtcaatcattcactcccccttcacaccatccccgtaatgcagctccgcttcctcccatattttccgccactcctccgattccggttccccgagattgtatgtctccaaatcttcacttcgtggatacgcattccggaacgcctgggcaatggcttcatccctgctgatcagcagtgtaagcgcactgtcccacgccacgatctcaatatcagccatcggatgctgaatggaaatcggatttttccagaaaccggtgtatccgtccgcatacggcagtccatagcttatcacctggtgcagcggcacctctttcttaaatcccgacaggacgccccagtaccacggataatcctgctgccggacaatctcctccagccgctccccctgcacccagaagaacgcttccctgcctaagttcccgccatacggctccagcgcctccggataattttcataccccgttatcagccagttccgttccgcgacagccggagaaatcgcagagaataccccggaaaaatacgagtaggctctctctccctttctcagaattacacctttcacagcctctcctcccggcggttcactcacccgccaaatttcgtaaatatgacacgcccaattcccatacacagaatggttactgcattataaaacaggatgacaggaaaaaacacctccggaattctccagaagatcgcaaaataagggacacagatcagaagcccgatgcaaaagttgacaatccttaaacgcggacagatgtcagaaatgtttttcatatcactgaccgggtacagattgccgatgacgagatagctgaccatctcggcgagatgcagtgtcaaaaactgcagaagaaagaaatgcagaaacggatgtatctttcccatccgtgacaaatgcatccccgtcaccagagccgccgccagattcactccaattcctccataagaaaccaccagatcccttcggggcggcagatggtcggcaagttcctcatcgacaggacggggtgtcgaaaagaacagatacggtttaaccgtcacgtgcaggaagcatctcttgcatccgtaaagctggtaaaaaatgcatgaatccggattgcattatctttaggaagggaatctgtcctgcagcagctatcgtccctgttccaacagcttctgataaataaccaaatcctgatcggtatagacatcaaatataacctgacggaccgattcattctgctttaagaaaccaacagccgtctccaccgcgatctccgccgcccgctcctgcgggaaacagaatacacctgtcgagatacagcaaaatgcaatcgaggtaatctgattttccacagccagttccagacaggaacggtaacagtccgccagaagccggcagtctgttcttcgcagcgggccggtaatgaccggaccgaccgtatgcagaatcgaatcacacggaagattgaaggcaggtgtaagtttcgcatgccccaccggttcctcgtgcccctgggcttccataatctcattacaggcgaggcggagctgaatacccgcataggaatggataatattgtcgatacaggaatggcagggccgaaagcaccccagcagcgcactgttggccgcatttacaatcgcgcccgtcttcagacgtgtgatatccccctgccagagacagatccggccgttctcctttacaggagccagatccgccccttccagaatgccgcgcgcggcattctcctccgacagatacaaatcctgttccgccaggaactccggatctgccggcatcggaggccttacgttcatcagggagcggagaagctgtttctgccccgcactatcctccggaatcactatgccgcgatactgaggcatctccttctgcatagcccggatcagatacctgaggcgttcttcctgggtcttgtaactctcatttttcaaatcacatcacctctctgactgcttccagagcttctgcaatgtccatgttgacatataaggatttttctctgatctcctccggcccccaggcttctccctgattgatgcagatataaaagccatgtttctccctgtctgtcagctgccagaacggatatttaatgattcccggcgtgttcatgccgactcccagttccagaaacaccagcctcctgttccgattctgtcttataaaaccggtatatccggcacaggcacgctcccatgcatcgtcctcaacgaagtatctgtcgcaccgcagattgacctccatgtcaccgccgcagaccggacatttcggcaccagctccgacggtattttcagatttttctgccgggctaccatggctcttacttccgtctcgttctcatacagcttcttatgacaggcctttgcacactgaaacataccgtaatcgccctgagtcgcaaagatccgttcttccggaaatccagccagctgaaactgatgatccacgttcgttgtcagaataaagtaattcctgtctttcaccagctgatacaaatccagatagggctttccagcctgaacatcgtagcggttacaataaatatgcctgctccagtacgcccatttttcctcctgtgtgggaaacgggtaaaaaccggccgaatacatatctgtcataccgtagtgctcgataaaatcaccgaatttctcccggaagcgcctgcctgtatacgttaaaccggcggcagccgacatcccggagcctgctccgacgacgaccgcctccgcttcctcgatgaatgtcctcaccgtggactgccattcgctcatggtattctctccttttttgcgctctcaccaggaatctctcatccgggagcgtgtctgaaaattaatttccgccgcactccaggattccttcgtcttcctgtctgaattataaaccgctgcagcctttacagcaagaacgcacaaaaaagtgggatagtaaccagttcgtttcttagtatccggcagatactattgctatcttcattaccggtagagcacatagtcctgcatctcgcggatgaaaccggccttttttaataattcgccggcattttcgggatattccttcaaaatcaggcgcttctgctcaggaaataaaagctttctctgaaaacagcggacgaactctgaaagtacagcctccatcccttcttcctcaaagtacctgagaacctttccctgacgctccatcactgcggccgtcctcccctgccggatggcgacagctgtccccggcagattcataaagcttctgtcctccggctgttccagagcctttccccatatctgagccggatccgctgcattcagccagaccacctcatcatccggctgttttaaagccgctgtcacgctctcatagtcctctttccggataaactgcgcccccgacataccggatacatagtatccgcgtcttacttttcccgtgtactcccagatccgaagcacatccagtgcctttctccaggtcattgcctccggctccggcttagcttcgtccgtaccgccggctgacagcacataggcagaatccatgcagggatcgcatgctttgcggtaggtctctttacagaggaccgccgtttcctttaaaaacaggtccagccactcttccatggtccttttctttaccggccgcacgatatcccagcggcctgcagacagcgccatcacccgtgcattcacccgctgtctcgccgttgccttcttcaccttttcccgattctgccactgtctcaccggcacaaagctgtccgcacagacaagacctttttctgccagcttaagaagcacctcctgggcgctgtcctgcttcggtacctccgtaagaaacttgagaaaactggctccccggcgcatcagctcctgatacagcagcttctcatcaccctccagttcctcagaaatcccggaaatcggagcctcccagtcgatatcttcataccggtagaaagccagtgtcccatcaggcttcatctgccagaaatagtcgccctgtgccaaaagcttgtcgagcatggcctctgtgtaattttttacacgccgtgcaaaaaagacggattcccagaatttgaccggatacgtccttccgcagatctgttccaccgctcgcctcagctgttcctctcccggcgcggcagcaaaggctctttcggccgccagcgccgcataatgcgccggcggctgagtcacagcctccagacgcatgcctttgattgaagcgcgtctggccctgtcgtagagcttcgcatggtaaaagatcccgtcgtcctccaccacgagtgattctgccgtcagcttttccagtatacattccgccatatcttccgggaaaaagtaccgctcactcaccgcttccctattctgcccgccgcggtaatagagcatccgccgcacaatatgcatggccgcttcctcattcccctccagaagagccagctcatactcttcccggtgttctgctgcaatccatatcccaggctccatataggaaactaattctctctccgccagattcttcagccactccaccggcacaggcagttctccggcaattaaatcgccttccatcattaaaagggaatgaagctggtcctcatcctccggaagcttcttccgagcctgaaccctggccagctcctccgcctgcggctttatcatatctgtctgcttcaattcctcatagacagcctcacggattccctgcgttaccggcgaatattcatacatctccgccgcttccgcctgccactggaacggaagagacatgggcgacggcacgtccacacagacttcccgtactgtaatgagcccagccctgatatcgcccaggatctttattacgccgtcgatatcccactggtcctccaggcattcccgcttcgtctcccggatcaggggatgccccggttcgttaatcagggaggagagcatctccgtgctcttcagccgctgcatccagagcggctgacggccattccgcttcattcccatcatgagcgcgcgggccgcattatagcgaaaggtcatattgaacagaggcgtcaggggaagcgccgcctccagaacactcctggcctgtccctcctcgatcttgaacagcagcccttccggaagaacgtcatccccataaggatacaaaagaaagccgtcctcctcatccacgcagccgatatcaattccgcataactgcctggccgtatgctgcaaaagaagagacagcggtgcattgacccgtctcccaaacagcgcatgcaccatgacctgattgcttcccgtatgatctccgaaccgttccacaacgatcgtcctgtcgtccggaagccctccggttaccacaatctgacgcctcaaaaatgaagccgcgttgcaggccgctgcgccgtcgaggccaagccgggtaagcgtgcctgtcaatgcgtctgagccgctcaccagttgaccactttcagatgatgggctatctccgcctgttggatctttcccggcctccgccgcctttcccagctcccggaacagccttccgaacgccagactggtgcgaagcgtcctgcctctcgtctcccccttccagaacggcagcctggctccctccgccggaacctgcgtcactaccacagtatcccggtcctggctgacgatcttccatgcaaaagatccaagcacaaacttatctccaatctgggattcatacacgaactcctcatccagttctcccagcttcactccatcctccgtcttcgccgcgtagagccccttatccgggatggtacctcctgccgcgacagccagcatacggctgtaggcgtcaccggtcacccgctcatgaatccggtcatagatcacccgcggacgcaccggaatctctcttccgtgctcgtaatcaccagccagcatccgcagcacgccttttacgtcctctctcgtcacatcgcgaaaggaataagccctgcacagaatgtccatcacatcatccacgctgtacccgtcgcctgccgccatggacaccagatgctgggcaagcacatcgagacagagcctcggcggcttcgtatgctcgactccgcccagtctggcgatctcggcagtcatgccgcagtagacgctctccggtgctgtcctgggatacatatacatcacgctgaccgaccccggattatggcccgcccggcccagccgctgcatcgtactggaaaccgtgcgcggacagccgatctgcagaacctggtctatctcacccacatcgatccccagttccatggaggaggtggcgcacagaagccggagccgtccttctctcaagtcctgctctacctccgcccgctgttccttcgaaagacttccatgatgaactctggcaaacccgtcaccgcccagcaggttgacgtaataggccagcttttccgcataccgccgtccttccgaaaatgcaatcacgcttctgcagtccagacacttctgatagaccgccatccccagttcttcccagaccggatcctttcttctcccgttggccggagtcgttcccaccacctcaattaagaccttcttctccatggccggagcgcagatgactaccggctcgggggataagtattccgcagacagttccagcggctctatcgtggctgacaggccgatgcgctggaggttacggccgcagagccggtccagcctcgcaatggaaagcatcagatgagccccccgcttcgtgtcgatcagagcgtgaagctcatcgatgatcaccgcctcagctgtcttcacgatcccctggcccgaccgtgaggtcagcatcaggtaaagcgattccggcgtgataatcagaatatggggcggatgcttcaccattctctggcggtccttctggggcgtgtccccagtgcggatcgccacagtgatctcctgctgcccttcttccctttcgattccatcaagcggccgtctcaagttttcccgtatatcgccagccagtgatttcagcggcgagacgtagatcagatagagcttttcctccagcctttcctccctggccagcgtacttaaccggtcaataaaaacgagaaatgcggacagcgtcttgccggtacccgtaggggcgctgaccagcaccggcttccctgctgcgatcgccggccacgcctcctcctgtacctttgtcgccttcccgaatgtctccgcaaaccaaccggctgtgggctctgaaaaaatcttaagaatgtcgtccgccatcgtaacctccatgcaaatgatttttctaatcataccatactttactctggattaacaggcgcctttttccagcgttttaactccgggaaaaactgtttcatcatattccgcgcctcttcctcactcataccgctgttcgctcctgccatcatggggacacagccttcaatcatctcttccatggtacagtccatcgcaaacgccccatcatgacagcagtatttacagtaatcttcattcctgcttccgtcttcgttcgttccatacagttcatccgtatctcccatcggcataccacagctctgacaatacttttcttccatttttcttcctcacagttcttttatctcagactcctttgtctggatcttaatcctatcacgacaaacacgtcaactgtatgtcatgattatccgggatttccgtttatttttaccatcaattttcccgtaccgggtactggaaatccctgaccgcttcattaaagtaatcattgaatggccgcatcagcagaaacagctccgacgccctttcacaaaaatcctccagatcacaaagtccctctgtctccaggcggcattcaatgtcccagcttttatactttaagtattcactttggggaaaatcagcgtcatatccacggggaacattttttaaacgctccccggtcatcgtaaaatgattttgaaaatccggagcggatacaatggtctccaattcctctccatggccgcagatataatcacggatcattgtcacagcgtccttaaacggggccgcatgcacgccgcctcccaaaaatacatttcccggagccagattcagatagtagccgcccggaatcggcgcgcggccggcaggcgatatatgggcgcgaaaagctgcatgataaggggatttgtcacggctgaatctcgtatcccggttcagacggtatataagattctttggcggcagtccaatcaccgacggatctttttccgccaggcgttccatcaccatctgaagcagctcttcaaactctgccgccgcctgttccttaaatgccttgtggtctgccatccattttaagtcattgttccgctcaagttcttttaaaaagtccatgatacagttttctctcatcacaccgcctcctatgcgttggaaatcatagaatagcagtccgatttcagaaattcattcagatactgccgcgctgcccttgtcgtccggtaggctggcagggaagaaaagaccagagaccggtcatcgatctcttccatcgccgtcttgcactcctgaaggaactctgtattttcctccagactggtatactccggcttctccggattcaccctgtgagtcgcgatcgcataggaaatccgtttactgcaggaacagacccctttaccgcttaagccgcagtattcatccagaaaaccagccatctttttcttaattctggccagtctctgcctgtaggcctccggagaaatctccagtatctcggctgccagacggctgtccacacgaaacatggttccgagaatgtaaatacagcggctgtccgtatccaggcactgaagcatcacgttcgtacaggaaagctttaattcctgctccagcaggttacggtccacccccatcgttaagtccggtatatccttttcttttccgctcacaatatcttcgccgtagtattcgaagctcagcggatgctgtgcaaacatactctttctgtagtttttcagatgattgaccgcaatgcggaatacccaggtggtaaaagcactctccccacggaaggaggccagattggtcattacccggatcagtatttcctgcgacgcatcctccgcgtcatgaatggtccccaacatacgcagggagagattaaaaaccagatcctgcaccccggtgagaagctgctccagagcccctttgtccccctccgctgccagtcttaccagcttttgtgtttccatttgttccttttcgttcatgtctttttcctctctttcgctttttgcaaatgacggttcctgcatatcttattcctgcatccaattagacaatttaatatcggatttgtgacataaaacttcaaataaaatagaaagttcttgaaagcgctggctttctgtgatattatacagttacaaataaatataagttcttcggggcggggtgtgattccccaccggcggtatagtccgcgacccactgtaacagtggttgatctggtgtaattccggaaccgacagtatagtctggatgagagaagaaattgtgtgacaggcagcagtgcctgacacggtttgatatgaattatgacgccctggatcaattatccagggtttttttgagttccgcaagccggacgctttgttctgtcagccgatcatcagaactgcaggaagccgcatgattcctcttagagatgaacttacaaaaccaaatttcaggaggatgcaacaatgaaagaaaacaaactgctgtcaacaaaaaatgtggtattaatgggcatgttcggtgcgctcgccggtgttctgatgatcttcgagataccgctgccatttatcgcacccagcttctacggtctcgatttaagcgaggtgccgattctggtaggtacgtttgcgctagggccgattgccggcgtcgtgatggagattgtcaagatcctggttaaattagttttaaagccaaccagcaccggatttgtaggcgaatttgctaatctgatgatcgggtgttccctgattctgccggcaggcattatctaccgcttccataagacaaagaagagcgcggtacttggcatggccgcaggcgctgtcatgatggctgtagtcggtgttgtcataaacgtgtatatcctgatcccattctattcgaatttgatgccgctggatacgattatccaggcaggtgccgccattaatccggcaatcagcaatgtatggacttttgccctcatctgtgtcggaccgttcaatattatcaagggtattaccgtgtccctgattacatcactcgtatataagagaatcagcgtcattatccacagtgccggaagatctgagagccgatcacaggcacgcacgtaatttcatcaggaaaaggaatcctattctaaaagattgtttaagaaagcgcagcatctgtgatcggatgctgcgctttcttcactttgatacctctttattctctgggacccactataaaatccgcatatagttctcttctgctgccgccgaccggccgcacgcccttgatgatccgatatctgccggactccagttctccatacaggcgttccagatccaccgtaagcgccttataggagccggagctcacctgataggtaatgctgttccagatcacgtcaggattcaccggtacttccgtcatctccatgccgtcaattctcaggagcgtcatctcgtctccaaacaggaccggcgatctggactgattatttatctccagaaccagcttcttttcaaacgcttcctcctctgaccgtttcaaatccagaaacaaatcagcttccggcttaaacggccggtccgcctccatcgccgcaggatcttctccgacaaaggaggcgtccgtggatataagaaagccgtattccgcccggcttccgtcatcccagacgagttccagcttaaaccctcgcagtatgccgcctgtcatatacgcagacatgtccgagctcagcatcgcgttcacattgggcgtgagacagaacctcatctcgtggttgtcatactccagttccgttgttatggttgacttttcatcgtaacgggggctcccgtcttctttcaggatataatcggaaaggatcgcctcgtccggctgcttatctccggtcagttctatggtaatccaccgccccagcggcagatacggaatctcccgttcctcttttgcaagcacggtaaatggctccggtccgcaggccgccgtactgaccgtatcgccgtcatctcccggctcattccacaggatcacaccggatgcgctgggaatctccctgctcttcctctcctgagtcactctgatctgtggaagcggatcgcccttcaccaccttgaaaaagtactggtaatgggagtaattcttctcatctccctgtgaaaattccagctgcacgtaatagtcttttccatttaccgggatgagaatatcggatgggttcatcacctttccgctgtccaccgtgtcaaataccatactgtagatgatgtaatgaatgggattgtccccattccccttaacctttatcttaaagtcatccgcatagaaaacctctggcatatggtactctccgtctgtctccttcacgatcttctccggagtaagccagaggccgcaggacgctgtctcctgctcgtttccatctttatctgtctctgttgtcaaattattcgtccagttctccaaaggcacataactgataccgttggataccaccgtcacttcccgttcttccaccggctgttccgtgggcctttcggcggtttccttcgtacatccggccaaagtaacggccagaaccagcattgtaaaaatcattcggaaatatcctgccatccgtattccccctgcctgccgcaatctgatttccccattctctctttatcataccataagagaacaggaatttctttgcgataacctgacgatttctttaatatccaaatccataccagcgcttcagactcccctcgtcaaatacgtattccggcgtcacaagaggatagttcagttccgcagcatagtaccacggatcgtccccgtgaaggggattttttatgatctgaaattcctgggccggcatatagccctgggccagcagaaagcagcggctgccgtctctgttctgcgccacatcagccaccatgacgcagtgtcccggactcccgccctttataaacatgtctcccgcctggatatcgctcacatttacaggaaccgcctcctcgtttaaggagagtgtaccagcgtagatcatcactgttcttaagtattttaaaaacgtctcataagaatcgtcggaaccggattttgaaacccaggaagtcttatttccatctaccaccagtctctttcctgatttccaggccggataatccattaaaaatccattggttaaatgaaacgcaattttatcgtagtcccccatcttccagaaatactccgagtagatgcggataatactgtcggcgcactgctgcagatcaccttcaaacaccggcatggaaaataccgccgcatgggcgctctgattttgtttctcacttccgtcgtagagaaggacaggactctgatccggtttcatcgcataccgccttaaatatccctgaaagcttcccatttccctgggaattctcgtatagccttccggtgtaaagaagcgttcctccaaagtctttccttccggattaatcagagaatcccgctttcccgatgactgctccggctccgtcacctcatcatcgccgatcagatagatgatctcctcctctgtctgcggtgcagacgcagcaggaacctgctcaccggcataggtaatgctctggcccccggttttgtatcccgaagacagaaccgccaatattaaactgccgcatatcaccgtatatctgatggttcccctcatacttttcctttccatcgtgcaccatgaactgcccgctccggcagggactttcgcttctttttcattgtagcataagtctcccgcgattactacacggaaaattgtcaggggtcatgccgctatttctcgaatacaaaccggatcgcaccggacttcttctcccctgccttcacggtctgaagcccagattcacggacgaatccttttgcaaaaaggttaaaacagtcggtcgaacaggactggttttcgatgcagaagaacggcgccttcggagtaaacacgacgatatggccaaattcctctgtggcttccagttttaccctgcagtcgttatagaagatttccgcatgcgctcccgcctggcagtccgtatatacgtgatccagggaaaggctgtccaccaacgcgggtgtgcgtaaatccggtaccgtctctcctgccggaatcagcttcccggtaggaatcttctcctccgtcatttccatgacagaagcggccggaacggtgatcttcactgcctgttctctcttattgaaatacggatggaccgcgatgccataggacatttctccctctccgcagttttccacctcatagctccagaccacctcgtcaggcagcgccttgaccgttatacttaatatacttgggaatggaaacatcgggaaatccggctgcgcctcattccacaacagaacaccagtcaccagggctgtctgtccatctgcctccgccgccttcacctcgaagggccgattcttcaccagaccatgcatcctggcatcatactgccttccaaaggcctgaatctttaactcctccgagcggttaggcgtcggatagaggaccggtactccgtacgtcgcctttctctgatagcgttcctcttcccaggcgatcatctggcggccttcccagtccatctgatagatattcatgccatcctccggattcacgaatacttccatggattcattctgaagaaggtacccttcttttccattccaaacggttttctcaactttcatcttctcttcctccagtcaaatcagcttgtttcagtatagcacaaaccgtcctgtttttccactgcacacgtcctttctggtgatttcttttctcaggatagccccgcggcccttctgaccgtctctatggcagaagcttcgtccacctccgcaaactctgtggtatcaaccgtaatcacaggatcaccgatgaaaaatggatccctcccccggctgtccagaatccgcagatcccgccttgccgaatctcattgcacctctattacgcaaaaaaacagccggacagatcacgcggtaatcaccgcgtaatcctcctgctgtcgtcatttactctctatatgcttttcacttcattactgccttattatctgagtccggcggcactggcttcatgacacgcctgtgcagcgatccccgtcttatgcgaatggattttcagacggatagagcattcccttcggctggttgaatccgatatcttccacgcccagatatttgaatacttcaaataatgcctttccgaaatggccgaacgcgactgctccgtggtgcggatagttcttctcgatcaaaacgtgacggtagaatctgcccatctccgggattgcgaagattccgatggaaccgaaggaacgtgtcgcaaccggaagaacctcgccctgtgcaacgtaggcgcgaagctgacaatctgccgtactctgtaaacggaagaatgtgatgtcgcctggaaggatatctccctccagagtaccctgtgttacttcctccggaagcgctcttgccataatcatctgatacttcatggaacatgcggaaagctttctggaacatgtattgccgcaatggaatcccataaaggtatccctgtgtgtatagtcgtatttgcccttgatatcgccgtcgtacatgtcatccggcaccgtattgttgatatccagaagcgttaccgcatcctggctcacgcaggttccgataaactcgctcagcgcgccgtaaatatctacttcgcaggataccgggattcccataccggtcagacggctgttgacatagcagggaacgaaaccaaactgtgtctggaatgccggccagcatttgcctgcaatggcaacgtatttgcggtagcctctgtgctcttcgatccagtcaagaagcgtaagctcatactgtgccagtttcggtaaaatctccggctttaagttgccctcgcccagttctttctccatatctttcatcacatcggcgattctcggatcgtccgcatgcttgttatacgcttcaaataaatccagctcggagttctcctcaatctccacgcccaggttataaagctgcttaatcggcgcattgcaggccaggaaatttaacggacgcggtccaaagcttataatctttaagctggataatccaaccagtgttctggcgatcggaaggaattcctcgatcatgtccgcacattctgaagcggttcctaccggatattccggaatgtatgccttgatattgcgcagtcttaagttatagctggcgtttaacatgccgcagtaagcgtcaccgcgtccctgggttaagttgtcgccgctctcctctgccgccgcgataaacatgctcggtccgtcgaaatgttttgcgagcagtgtctcggagatctccggtccgaagttgccaagataaacgaccagtgcattacatcctgccgccttcacatcctccagcgcctgtaccatgtgaatctcactctctacgatacagaccgggcattcatagatgttcttcgcatcatatttggcagcatacgcctccacaagagcctttcttctgttgacagataatgattccgggaaacagtctctgctgaccgccacaattcctacttttacttctggtatgttgttcatatgtattttcctcctgattctttctatttattgttctgcctgctgcttcactgctcattgcctacgtgcaggttctccccctttaagccaataaaagcatttgccggaagaccgccctcttcgtggccgatcagccatttgtttcttgcgaagagtaattcgtcctcttcattcttaatctccagcggttccatatctgtgttggttccccttggaaggacaactacacaccggaaacctccgtcttctacgtggcagggcgcgtagtgaagtgtggtgccgtagacttcgattaccgttcccgccggtaccaggaaggcctccatcagagatgtgtcgtacgtgtaatctgccccgatatcctgctgttttccaatgatcaggacgagatccgtcaccgcaatgttgatctcagagtttctgtggtattctacagcgtttaacttcgtattgtgaccgttgcagtagccgatctgaatcggaagctccccgtacacattgttctgaatgactaaagcctcaggcagcgcctccagctccggaacggatggtacgtagataacatcgtccgggagaggtgtatgttccatctcttttaagataccggttacatcaagaccggtaatcacctttccgtaggcagaaaacgctttgtctgaaatgtctttgatctgcattcccatttaagtattcctcctcttctcctataaagcagcaagcttcttatagctgttcttcaaattcccataaagctctttatagagttcatggtacgccttatatttgccaaccacactcgaatccgctccggtgctctgcgcctcagaaatcagctcgtcgcaggcctcctccacgctttcgtagattccgcatccgactccggccagaatcgccacgccgagtgccggaccttccgtctgtctcaccgtattcacactgcagtcatataaatctgccagcatctgtctccacacagggctcttgccgcctccgccgcaggccatcatactgtcaacatcgatgcccatctcctttaaaatgtcattgcagtcagagagagagtaggaaacaccttccatgacggcacgcagcatatgagccttcgtatgaatcgcagagagtccaaagaacacgccgcggcagtcaggatccagatggggcgttctctcccccatcagataaggaagataaatcagcttatcactgccagccgggatattggcaatatcacgattgatcaggtcataaacgtccacgtcctgtctcgcagcctcttccacatagtcctgacagaaattatccttaaaccattttaaagaaagtccggccgcctgtgtcacgcccatgacatgccacgttccaggcaccgccgcgcagcacgtatgcacgcgtccctttgggtcgatcgtcacctggctgctgtgtgcaaacacgaccccggaggttccgatcgtcgtaaatgccgttccgtcctttacgactccggtaccgactgccgcagccgcattgtcaccggcgccgcccaccacctttgtctctgtggaaagtcccgtcttctccgcgatatccggcagaaccgttcccgtaacctcgcaggactcaaagactttgccgagaatagctttatcaatgttcagtttctccagcacctcatccgaccagcagcggttcggcacatcaagaagctgcatcccactggcatccgacacctcagtcgcaaacacaccggtcaatatgtaacggatatagtcctttggaagcagaatatgcctgcatcgctcataattctccggctcgtgatttctcacccataagatcttcgccgctgtccagcctgtcagaggcggattggccgtaatctcaatccagcgttcccggggcatgatctccagcatctcttccacttcttctccggtcctctggtcacaccagataatggaaggacggatcacattcccagcttcatcgagcatgacaagtccgtgcatctgaccggaaataccaattccctttacctcgtcctttcccgctcctgccttcttcaccacgtcttccacggtggcaatcaccgcgtcccgccaatcctcgggtttctgctccgcccagccgttatgcggctgatacagcggatactccctcgaagccgatgcaattatattgccttttttatcgaacagcacggtcttcgtcgccgatgtccccacatcaataccaattaaatattccatttgctgcctccttacctgtttcacgcaatttgccatagtttcattataccgttttccgccagattacgtgagcaagaacttgaccacctaatagcactttcttgcccttttcctatattcactgggcagacagccgtaacgtttcgcaaacgccttcgcaaacgccctgctgtccgagaatccgtgattcacggcaatatcccccagctcatgggctgtatgcaccatctccttcaccgcgtactccaccctcaaatcctgcagatagtcgcggtagctgatattggcataccgcttaaatattctggataaatacgtaggggaaaaaccaaagcggtccgccaccttttctaaggacagtgcctcgtcgtaatgatttttcatatactccgtaatctccgacagcttctccaaatggatcttctgcctgataatatccggagcctgagcctgatccttgaactccgtcagaagcagatacttgacaaattcaaacagcccgttgaccttcagctcccaggcatacgtttttctctcatacgtccggtacatctccatcacaagacccatcagcttcccattctgctcccccgatctcctggaaaatgacagatacggctgctcctgcaagtaaacctcaaatgtctgcacaggaatctgcaataccagggtccggtttggaagcggcgcgtcgatcgcgtgcacttcattggaattcactataataaagtccttctcaccaatcggaaaatggttctcccccagataaaaatcgatcttcccctccataacaagaaaaatctcaatcgaccgatgccagtgactggccctcttatacttcccctctccgccctcaaagagaaacagcttaaacggcaaattatcattcggtataatcatctcatgactggaatccatctcttctcctcttaacattcttaagacagtctctgcaactgactctgatagaaaaaacaggccatccactgtatccattggcctgcctttccgggttaccctgttatctttgttccaaaagttttttcaaacgttcgatttccttctgctgctcctctatctcccgtttacgttcctctatctcctgctgctgttcctccatctcccgtttatgttcctctatctcccgctgctgttccacaatctcccgtttacgttcctctatctcccgctgctgttcctctatctcccgctgctgttcctctatctcctgcttctgttcctcaatcatatactgcactgtatttctatccagaatctccaatgctttcgaatacatacccaccaactcctctggttttacctgaaattgagctatctcttcgtaaatttcgcggaaatccgggtatctctctataattctcatgatatcctccggcctgtcagaacttaagaagagcagccatgcctctatttcctcatttaaattgtaagtgatttcccggaaaacatcaagagccacaaaaatatatttctgcagtaaatccagttccagccccgtatcaaacacctggctggagcggtgaatatactgtccggctattttgtgaaaatccgcgctgctgttctcaatcaggacaatggtatacacattctgaagcttcttatatgtagacccattctctttcctgccttttgtccggctatactgccgaagtatcagatcagaagaatagcaggcggcccgctctcccggaaatgcgtagccaatacgctgaatttcaatgttcaccaattctccgctctcaagttctgccagtacatccataatcagcagagagccttccgccgtaatccggttagattccggggataacacccgttttaccgccaccttctgcttcataatgcaggaaagcatcatggataagcggtcattgtgtacatccggatcaaaaaccagtttaaaaaagggatcataactgattttcagtccgctgcttcccatggaaaacccgatcagctcctcctgaaattcattcgtcaggagttgaaacttatgccatatatccggattggttttcagcatatccaacacctgttctctgcttcttgtcatcagcgggaataatggctttccggtctgtgcgttctgtgcctcccgtccctttaatcctccttgctttttttgactttctaatacctgttgtggtttcacctgtgccatatgcactttcctccttagattcctgcctctgagcttgcggccgatacagccatgaacggttctgcaaatcacggttctaaataaccattttccgacaatccaaataccgattagaattacatagaaatgtgtctaaaattcagcagaagatatctgcctgaatgagtttattatacctgatattcactatattttcaagtatattttactatttatgagattatttttcactaaacctccgattacccatttaattagtgtccgcaaaagtttctgcaaaaattcacagtgcaaagagtctgccttactggactttcgcaccgaagtgcgttttctatagcagccattctcccctggcgcagagtacggtcctcgcaaagtatacgaaacacaaaaaccgcccgcacaggatcagaaagcgatcccatgggggcggcgtagcttttgcatatctataactcagaaattattcctcgtcagaataaaccggtgcatcttcatccatctgagacatatcctgcatctgaagggccttcatgctcaggctgatctttctgtcgtcttcgttgaagtcaacaaccttagcctcgatctcctggccgatggataatacgtcagatggcttatctacatggtctctggaaatctgagatacatgaagcaatgcatctacacctggttccagctcaacgaatgcgccgaaatcagtcatacgtgcaactctgccggttacaatattgcctgctgcgtacttcacagcggcatccttccacggattggtctccgggaactttaagcttaatgcgatcttatcaccattgatatccttgattaagactctcatcttctcgccggctttgaaaaccttcttcgggctctcaactcttccccagctcatctcggaaatatgaagtaaaccatctgcgccgccaaggtcgatgaatgcaccgaaatcggttacgttcttaatcgttccttctacgacatctcccggatggattctctcaaataattctttctgcatctcggctctcttggcaaccataagctgctttctgtcaccgataattcttcttctcttcggattgaattcggtaattacgaattcgatctcctggtctgcatacttggataaatccttctcatatgtgtcggataccaggcttgccggaataaagactctcgccccttccactactacgcttaaaccgccgtccagaacagcagctacctttgcggtaagaacctcatggttctcaaacgcttcttctaatctcttgtttcctctgtcagctgccagtctcttgtaagataacgcaacctggccttcgccatcgtttaccttaacgactttcgcttccatctcatcaccaacagatacaacagttgcgagatctaaattctggtcatccgtgtactcattacgcgggatgatgccgtcggatttaaaacctatattcaagactatttcatcttctttgacgtcgatgactttacctgtgacgatctctcctgtacgtattgtttttaatgattcctctaacatttgttcaaaacttaactctgacattagtatgaacctcctcgataatatgattcggggttgaagccccggctgtaatacctacgctgcgcacagaacttatacattcaggatctaaatcacctagtgtctggatatagtaagtgttcttacattccgtttggcatatctcgtacagcttctgggtattggaactcgtcttcccaccaaccacgatcatggcgtccacttctgaagctatccgtcttgcttccacctgtctctcctgtgttgcattgcaaatcgtatttaaaacaagtatatcataacgcgttttagaaaatttttcaactaaatcttgaaatttcttgtaattaaatgtcgtctgggacacgatacacagcttttcaccctctgaaaacggcaaattgtccacttggtcgggtgtttccaccactaaagtattatcatttccccagcctttaataccctgcacctccggatgcgattcatttccaatgatgatcaggcgtcttcccgcctgattctgttcctgtgcgatcttatgaatcttcttcacaaacgggcaggtggcgtccacaatctcgatgccgttttcttccaggatatcgtaaacatgctttcccacaccgtgggaacgtacgatgacgattccgtcgcggagtgccttaagctcctcctctgactcgatgacccgtacgcccttttcctcaaaatcctttaccacttcttcgttgtggatgatcggaccgtaggtataaatcggttttccggcgtgctctatctgttcataaaccttgtccacggcgcgtttgacgccgaaacagaagcccgcggtcttagcaacaatcacttccataacgttttgtctcctcactagccaatcccttttacggccgccagcctgagtatccagccgatcacctcgtcgatggtcaggccggaggtatcgaccagaaccgcatcctctgcctgcttcagcggggagttttctctgtgcatatcgcggtaatctctctccgcaatctccttttcgatctcctccaggctgcacggctcgcccttttcagtcagctcgtcgtagcggcgttttgcccgcaccgccgtgctcgctgtcagataaatctttaaatccgcttccgggagcacgcacgttccgatgtccctgccgtccatgatgacattctcatttctggccagttccttctgcagctccaccagcttctcgcggactggtaagtatatggaggaggcagaggccatctggctgacctcctccgtccggatcagaccggatacattttctccgtttaatatcacctgctgggcgccgtcctcataggaaatggtgacgcccacctcttttaccgcctctgaaatcacggcttcctcgtccggtctgattccttttcgtaaaaaatacagcgccatggcccggtacatggctccggtgtccacatagacgaagccgagtttcgcagaaacagcctttgcgatggtactcttgcctgcccctgccgggccgtctattgcaatgttataaatctttgacatccttgactctccttttatctatggggacgcgcccctctctgtctcttctgccgcacaggcccacgtctgactcacacacgcctcttctgccgcgcaggcgcacgtctgacttccagtcattcaggatccggcctggcagcctcgtttccggccgtccaggcggtagaccaggcgatctggaggttaaagcctcctgtcaccgcatccaaatcgagcacctccccggcaaagtaaagcccggaaaccagcttcgactccatggtagagggattcacctctttcacagatacgccgccctgcgtaatgatggcctcgttgtaatcgcgaagccccgtaatcgtcacggtaaatgatttcgtcgcctggattatctgtttccgttcttccctggtgatctcattcaccttcttttccggagaaatcccgctccgttccaccatgaccggaaccagcttggatgggaataaatgaaccagcgcgttcttaaactgcttgtttaaagtcccctcaaattcacggagcagccgcgcatccagctgttcctccgacagcgccggttttaagtcgatgacgagagaaagcggtcctttcttcaattccttcacggcgtagctgctggcgcttaagagcaccgggccgctgactccgtaatgggtgaaaagcatctccccgaactcccggtagatcacctttttgccgcgcatcaccacggcttcaatgttctttaaggaaaggccctgcagctccttcaccaccggttccttcaccacaaacggcaccagggctggtgaaagctccgtcaccgtgtgcccggccgctccggcaaaccggtatccgtccccggtggagcccgtagtcggatacgacaggccgccgcaggccacaatcaccgcatctccgtacaccttcgtctccgcgccgccctttttcaggagaatcccgcggcaccggccgtcttccagaagaagctcctttacctcagagtgaaggtgaacctccgctcccagtctcccaagcattccggacagcgccttaatcacgtccgaagacttgtcggacaccggaaatacccggtttcccctctcggtcttcagcggacagcccgcctcctccagaagtgccatcatatcaaaattattaaatccataaaaactgctgtaaaggaatttggaatttgtcaccacattccggaacaaatcctcggtgtcgcaggcattggtcacattacagcgccctttgcccgtgataaagacctttttccccagcttttcatttttctcaaaaatatggacggtgccgccattcctggctgctgcaatgcctgccagcatccccgcggcgccaccgcccacaatgattactgttttcatttcctgcctcctgctccctattaatttacactaaaagacaggaaaacacaagcaggactaactgttattttttgccgcacgcctttacccgctcctccagagcatcgaccacagtccttaagaccttcacgcgggcatagtacttgcagttgccttccacgacaacccacggcgcgtacgttgtggaggtgcgcaccagcatctcgttgacagcggtctcgtactggtcccatttttcccggtttctccagtcctcgtccgtaatcttccactccttcgccggattctgctggcgttccttgaatcggcgttcctgctcgtccttgtcgatatggagccagaatttgatgaccacggccccggcattggccatgtgggcctccatctcgttgatttcctgataggcccgcttccagtccgcctccgaacagaagccctcgatccgttccaccatgacgcggccgtaccacgtccggtcgaagacggcgatatggcccgccttcggaacgttgttccagaaccgccacagataatggtgcaccttctcgatatcattgggggaggcggtcgggttcacacggtatccgcgtggatccaaatgactggtgagccgtttgatagcgccgccctttccgcctgcgtcccagccctcaaatcctaaaaccaccggaattctcaggcggtaaatctcgctgtgcagaaactccaggcgcttttggagccggtcgatctcttttttatactcttccttggtcagcgtcttcgtcagatccacaccggagagcacaccgttttgatatctctcttccttcaccggaggtttctcagacacttccggcttcggagccgctttctctctcaaggccgcctcgaagcggtccgctacaagggtcatgatcttggcggcggcgtaatccttgtccgtcgcctcgatgatggaccacggcgcacgctccgtatcggtcttctgaagcatctcctcgttgatctccagataacggccatactccttgttcctccgccagtcgtccttcgtcacacgccaggacgtctccttggagtcctccagcttcttgaagcgcttcttctgctcttcctgggaaatatagaggaacagcttgatgatcaccattccgccgtcatccagctggcgctcaaacgataaaatatcctgaaaggcctccggcagattcttctccttgatctgtccgtcgaaccgttcgatcgtcacctggcggtaccagctccggtcgaagatggcgatccggccgtcggccggtgtcttggtccagaatctccacaggaacgggcgaagctgttcttcctcggtggccttgctgttggcaaagacctcgaatcctctgggatccatcgcctgaatcagccggttgatctgcgttccttttccggccgcacccatgccttcaaacacgatcatgacagggatccccgccgttctcagttcccgctgcaaaaggcccagtctttcgctctgctctccgatgacctgcttgtacgtatctttatccattttcttcgataaatcaattttttccagcataacccgttcctccttcaatcattcttccgtgaaagcctgttttcctgccaatcaggcttctgtcttctcaaacacctttgcaacttccttcatgacctcgcttaccttgatcatctgcggacattccttctcgcagcggtggcaggagcggcagtcgcccgccttcttttccagagcctcgtactccgccctggcatcttcctccctgtgcgccgcagtcatgttgtacagcgagaatatcttcgggatatccaggccaaatggacatggcatacagtatctgcatccggtacatcccaccaaagccatggaatcaaagacgcgctttgcctcctttaccacctctttgtcctgctccgtcgccatacccacgctgcttctcttcgcgtactccagattctcttccacctgcttttcatcgctcattccgctgagcagcaggctgacctcaggctgatcccagaggaaatccagcgcgtactccacaggagacttgtcttccggaaataccttctttaaatgggatgccggattcgccagcctcccgcccagcaaaggctccatgatcaccaccccgaggcctctctcagcggcatacttaagcccctttgttccggcctggtgctcggtgtccacgtaattatactgaatctggcagaaatcccatccatcataataatctatgatatcctgaaacacgtcatatgaatcatggaaggaaaatccaagatagcggatctttccctcagccttcgctttttccatccgcttaatcagttcaaacggctttaccttatcctccatgcgttcgccgctcaaggcgtgaagcagataaaaatcgatatgatccgtattcagcttctccagctgctcatccagcagagtctcgaaatcctccgccttctgaagcttccatacgggacatttggtcgccagatacgttttctccctgtagccgtccgccagcgcttttcccacgatcctctcgctctctccctgatggtaaggataagcggtgtcaatataattcacgccctcatcgatggcatgacggatcatcccgatggcgcgttcctcatcgaccacctcatcgtgaagcagtggaaatctcatggttccgaaccccagcgctgacactttaattcctgtctttccaaaattgcggtattgcatcttagtcctccctgatgtataaaattttgattttattttaccacatatttcctgtattctaaagtattttctggcagtttccctgtttttcgtcactgttcagaccaaaaactatttcgcaggccgcagacagccgttcatgtcccatatatttatctgcaccggttgtaaaatagttacagatctggtaaaatagggtatcaacaaaagaaagaggtgactgttatgcaaaaatacgtttgtgagccatgtggatacatatatgatccggctgatggggatccggacaacggtatcaatccaggcacagcttttgaagatcttcctgaggattgggtatgtccgatctgcggaatgggcaaagatgtctttgttccggaggattaataagtactgcaaaaaaaccggttcgcacaggcttttaagcctcagtgcggaccggtttttcatttggatatatggtataccatttatcagatttcggttgagataaagatatcgtagatcgccttgatggccgcctcaaaatctgcattcttaacgccgataatgatatttaactcactggagccctggtcgatcatcttgacgttgacacgggcgtgggccagcgcggagaagattcttccggccgtgcctctcgtggccttcatgccgcgtcccacgacagcaactaacgccaggtcagattccagttccacgaaatcaggctcgaccgcgcggtggattcccgcgatcacggactgttcgtattcctcgaattcggactgatggacaaatacggtcatggtatcgattcccgaaggcatatgctcgaaggaaatgccgtatttttcaaatacctccaggaccttgcggccgaaccctacctcggcgttcatcatggctttctcaatgttgatggaacagaagcccttcttgcccgcaactcccgtaatggtatagcgcggcttcctgcaggtgctctccacgatcagagtgcccttctcctccggcctgttggtgttgcggatgttgatcggaatgccttcttttctgaccgggaagatggcgtcctcatgcagaacgctggctcccatgtaggccagctcacggagttctctgtatgtaatggtctcaatgacctccggattatcgatgatgcgcggatcggctacgaggaagccggagacgtcggtccagttctcatacatatcagcatggatggccttcgccacaatggagcctgtgacatcggatccgcctcttgagaacgtgcggatgcttccgctgtgagtggcgccgtaaaagcccggaataaccgcgcgctccacatgctctaagcgctctcccagctcacggttggtgatatccgcctcgaagctgccgtcttcatcgaagaagatgacctctgccgcgtcgatgaattcatagcctaaatagttggccatgacgatgccgtttaagtactcgcctctggatgccgcgtaatcacggccggccttctttaagaaattctcctcgatggtctcgaattcatgatccagattcaggtttaaatcgagtccgtcgatgatctccatgtaacggctcttaatcttctccagaatcttcttgtagctttttccctcggccgccgcatcgtaacactgatacagcatatccgtaaccttctcgtccttgtcgtttctcttgcccggcgcggatggaaccacatagcgtctgctcttttcggagcgaatgatgtccccaaccttcttaaactgtcttgcactggccagagaactgccgccgaatttcacaacctttttcatgtcttctttctcctctgtcacatatccaatttatttaacggaaataatatcgtacttgccgggcgctgtcaagtgttttgtaaaacggttttttcagcctcctggcgcgcggccagaactttatgatgcttcagccagcctcccgacgcgacacgcgcggcgtagaccaccgctcttacggcccagtccagaaccatggcaatccagacaccgatcagccccatgccaagataccgtcccagaatgaagctcatggcaatccggcacagaaacatggacgcaatggtaatgcacatggcgaatttcacgtcatctgcggctcgcagggcattgggaagcgcaaaggatggcgcccagatcagcacgcagcatagcccatgaagcgtgcagatgattctggccagctccgccgtctgttctgacacatggtagaagccgataatgtgcggcagaaataccagcatcggaaaacagatgaggaagtgcgctcccatgatgaggaaaataaagttctttgcataccgtttcgcctcctgataccgtttcgcgcccacggcctgccccaccacggttatcatggccagggagatggcgctgcccggaatcacctgaaaggaacagatggttcccgctaccgcattggcggcaatggaggtcgtaccgaagctggagaccagccccgccacaagaagcttaccgccctgaaagaggccgttttccactcccatgggaactccgatccccatgatccgccggatgatggcaggatggaagcccagatgaaagtttttgtcgatgcacagcggaagcttcggattccggatcacccacaccagaatgactgccgcggtaattcgtgacagcagcgtggagatcccggccccggccacctccagatgaaagccgtaaatcagaatggcatttcccacaatgttgatcccgttcatcagcatggacaccttcatggatatcccggaattacccatagaacggcagatggccgccgacccgttatacactgccagaaacgggaacgacagcgccgtcaggtagtaatacgttctggcataattcataacggacggttcgatcttcccgtaaatcgttcgcagaatctggtagttgaacagtaaggacagcaccattaaaaccgttgaaaataccagaaccacaagaatcagctgattggaggcctttaacgcctcctccctgttttcgtcccccagctcctgggccgcgatgacagcgcctccggtagccatggcggtaaacacgttgatcagcagaatattaagcgtatccacaagggaaattcccgagaccgcggtctcccccactccggccaccatgatcgtatccgccattcccactaagacggcgagaaactgctcgatgatcagcggcataatcagccgcctgatggccgccttcgaaaatatcggtgcttcttccatttctctctccctattgtatactgccctccggcttcttatgaccgtttcgaagcattcggaggattcgtctgtttgccgcgtcattttgtttgtctgacacggacatccatcccgaaaaagagtcgtcctgattcgcctcgccgcagatgtccacacccagaatccggcggctctccaggcatcggtacgccctctcaagctgttccagcgtcatggttccctgatcccagtcagtcaccacttccttccgcccgaacacgtccttgtctatggacagatacacggcctccgacacctctgtttccagagccttaagccatgagtcatctgccccggccgcgctctccgaaaacacctgcacgcggtcctcatactctgattctacggtatctgccagcgaatccgcgacaccgatcaggatcaccttttttaagtatggctggtcgtccagagcccgtttgatccagcagccgcaggacaaaagtccggcaaatatagaaggcttcatatccgtatgatggtcaaataccaccagggtaaacggctcccggattttcctcaccatgagatagcttaaatagtggaaatttccgccgtctataaagtgaatccagcctgacatcccactgatcctcgcctcaatctccttcatggatgcctcatcacagaatccgtttaccccggacaaatccgaacagtcaatccattcacagtccccatctttatagaagctttctctttcgtaaactcctgtaaaattcagcactgaaactgatatcatcgttctcttctcccgattggtctttcctttccggcgctcttaaacgcccagcttttccatctcttcgctgacagaggcctcgcaggaacgcatggcctcaatggtcttttcaaacagctcctctaacgtccagccaagcctctcggctccctgcgcaatcacctcgcgggaacagcctgccgcgaaccgtttatccttatattttttcttcaaactggagacctccatatccatgacgctcttcgatgggcgcattctggcggcggctccgatcaggcctgtgagttcgtctgacgcgaacagtaccttctccatatcatgctccggttccacatcagagacgagtccatagccatggcttacgaccgcatgaacaagctccggttcagccccggcttcggccagaagctccggcgccttgatgcagtgctcctccggataattttcaaaatccacatcgtggagaaggccggcgattccccagaaatcctcgtcctcaccgtatcccagtttctttgcataccagcgcatggtgccttccaccgtaagcccgtgaagtatatggaagggctccttattatatttcataagaagggaaagcgcctggtctctcgttacatttgttttcatattcctgtcactcctctgtaatttttatgttgtcatccatcatatcactgctgatttccgatatcaagcttgaaatgccgctttcccccacaactttgatcccatgctccttgagaaggcgggctgtcaccccgtctccggccgtcttagcacccgaaaaggttccgtcgtagataatcccgctgccgcaggacgggctgcgctccttcaaaatggcgtaccggcatccatacagctttgcgatcttaagcgcttcctccccgcccttttcaaaatactctgtcacatcctggcccttccggttcatcacctggacacgcccgccgtctctccggcattccgacggctctctgggggtctccatccctcccatctgctccggacagaccggaatcagttcatactcccgaagcagcttcagcacctcgtcacgacggccgttctttccgtcgtagcggcagttgacacccagcagacaggcgctgaccagtattcttgtatttttcttatccatggataagcctccttccaaaatcgtctccgggaactatggcctcagatcccttactattttcagtttgttttcattacatcccgcatcttccagcatggaatccatgtattttccgaaaaagagctctgcgcctttttctttccaaagtttccagccctcggtatccgtcacttcttgttccggttttgtcatgccggcaaagtagttccggttcatctccacggccagttccgtcatctgcgccagctcctcctccgaaactgacagcgcttccagctctttcttcatcttttttcgcgtgcacgcgtcaaaatacgcctgggacagcgcttcaaaatccccatattcaccggggattccagctttttccccatcccatcgatccacatttaccggcttcgtttcatacgtgatgcttccatccggatcaaccgtcaaaacgccgtaccggtgcgggaacacggtgagggatccggttgcgatgtcataaaggccgccgctctccgcaatatgctggatatgaacgtgaccacttagattcaaagcgatcccatgagctttcagcagctgttccatctcctcatgatgatccagcaggaagccctgtgacagaagtttgttctgagccaggacattctggtgagtcaccgtgatgatggaggcccccgcttcctcagcgcgtttcatctgccgctccgcccactgcatcgtggaatccttaatctggccgggtgcctcctccgtattcgcgtccagaagcagcagccagacccgttccgacagctcatacagaaagcttaaggattcttcatcctttccagccgcgtcctgataccccagactgccatatatatcacgaaattcttcgccgctgacccgttccgtcctcgtcaccgtctctgcctcaaattgggcggcaaacggataaaggatatcatgatttccgggcagcaccagaaccgggattccctgttcctgcagcttgaacagtttcccggccagttcctcatggcttgtcttctcaccgttaaaactgagatctccgcttaaaataagcgcgtccggatgcagcttctctacctcctctaaaaaagcgtccgtaatctccggcgcatactgagtcagctttccatccccatttccgaccattctcataaatccggttccatagtccgtaagctccggtgataaatagtgcagatctgtggcggtcacgacggtaagcggagaagtctctttctccgccaatggcctgctgctcccacagcctccaagcgcggcacagagaaatgacagaaatacaatatgagtttttttgatcatagacgcccccatcctgtttattttaatttcgcatatcaaacagcttcattatatcaaacctctattcgaggcacaagcttgtaaaagcggtaacactgccttataatgaaatctgcagcttcatacaaccgctgaaaaggatactatgtaatttatgaaaaagaaacacagcccgattttgtataaaaaaagaataaaacatctgatttccgatgtcagacactgcctgcccggaatgcttctgtgcgcaatttttctgtctgtcatgactgccgctgctggcaaggtgtgcccggcccggctcttattggggattccatgccccggatgcggacttacccgagccaccgtcctgctgttaaaaggggatatccatggcagtcttctgtgcaatccatttctcctgccgctattggccggagggctcttatttctgtacgagcattacgtcctggaacgaaaagcgcgcctgttttccgtctacatagccgtctgcatcttcctaatggtggtggtctatatcatccgcatgaaatactggtttcctgaccggccgcctatgatctatgagccccggaacctgctgcacctgcttttcacagttctgaaatcaccggggagcctgtaacccggcaaagaaaaaatagacaaattctgacagtatatgatataattttaacggtagatagattaaattacaggaggtactaagtatggaaaacaacacaatggcgacagatcctaataaggctgtcatgaccatgggggaatggctgatcacgttaatcgtcctggctatcccatgtgtcaatgtaatcatgtattttgtctgggcatttggcaatggaaatgagaacaggaagaatttctgccgcgccggactgatcgttatggcagtgggaattgtgctgaccttaatcttatatgccgtagtcggtgcaagcctggctgctgcgttaagtgcaggctattaagtttcataagactgcatcatccgataaggggcggccgcaccgatgattgtacaatcatcagggcggccgcccctttcgtatcttcttttcagatttatgccttattatccctctttctcatcaccgtatcaataatcccatattccttcgcctcttcggcgctcatgaaatgatcccgctccgtatcccgccagatctcttcctccgttctccccgtattttccgccagaatccgattcagccgtctcttatcctgctgaagcttctctgaatagatctggatatccgtcgcctttcctccgatcttctccaccgccggctgatgtatcatgatttcggagttagggagggcaaagcgcttgcccttcgttcctccggccagcagaaatgcgccgaagctggctgcaagtccgatacagatcgtcgatacatcgcaccggatataacgcatcgtatcgtaaatggccagaccggccgtaatagaaccgcccggactgttaatatagaaggaaatgtccttcgccaggtcctccgcttccagaaacaacagctgggccaccgccagccgggccgtctcatcgtttacttcttcccccagaaagataattctgtcctttaacagacgggaaaagaggtcgtaactgcgctccccctttgacgtcgtctcgatcacactcggtaccagactcatgccgcacacctccagctattctttctttcgcagaaggcggttacccctgtcttcttctgctttgtctgctcacgaagaggcgtgaaatgcttccgttcccggtaggtaaacggcgtgcatccgtaagcccgccggaatgccagtgtaaacgcctgctgagactggtaatccgcctcgccggatatctccacgatcgtcttgtccgtctccaccagctttctggccgcctccgtcagtctccgctccatgatatagcggtgaatggtacagccggtttcctcagcaaaaatccggttcaaataaaaacgggaataccccgtatgtgcttccaatgcttccaggctcaaattttccccggttcccatgtttttctcaacagactccagaatgtcctttacgattctgttttttccatccatttattgccacacctccagttatgatccaatgcaaaaccatcttcctcatgggaaatcaggtctcttttctcccattataacaggctgtcttcactctgtcttaataaaaaatgatgtttccgctaaaaatccatccttccggttatactataatgcaatggaccgctgaattcatactaagttcgtataaaaatacaatgacattttcccgattttgtagtatacttcttacgaaattatatgtgtgagattatgacgaaaggatggcttcattatgtactgtgtaaaaaatattaaagatgacctgttctgggtcggcggaagcgaccgcaggctcgccctgttcgagaacgcataccctattccaaacgggatctcctataattcttatcttcttttagatgaaaaaaccgttctcttcgacacggtcgaccgggcaatcaccgggcagtttttcgaaaatgtggaatccgttctggcaggaagaacgctggactatgtgatcatcaatcatatggaaccggaccactgcgcaacactcggcgaactgatcagacgatatccggatgtctccgtggtctgcaacgcaaagacgattccgatcatcaagcagttctatgaatttgatatcgataccagagccgtgatcgtgaaagaaaacgacaccttctgttccggcagacataccttcaccttcctgatggcccccatggtacactggccggaggtcatggtgacgtatgacaccacggacaagatccttttctccgcggatgccttcggtaccttcggcgccatgaacggcaacttgtttgcggatgaactctatttcgaacgtgactggctggctgatgccagaagatattataccaatatcgtcggaaagtacggcgcatcggttcagacgctgcttaaaaaagccgccgcactggacatcgaaatcctctgcccgctccacggtcctgtatggagatccgatatcgcatggtatgtggacaagtatttaacctggagcagctacgaaccggaagagaaagccgtcatgatcgcatacggttccatctacggcaacacggagaatgcggcgaatattctggcctgccggctggcagaccgcggcgtgaagaacattgtcatgtatgacgtctcctccacacatccgtccaccatcatctccgaggccttccgctgcagccacctcgtattcgcttccgcgacgtataacggcggcatcttcagctgtatggagcacgtactcctcgatttaaaggctcacaatctgcagaaccgcaccgtggcactcctggaaaatggttcctggggcgtaacagccggacgtaagatgggagaaatcatctccgagatgaagaacatgaccatactcgatgaaaccatcacgatcaaatcctccttaaaggaagaccagatggcggaactcggtgctctggcaaatttaattgtagattccatgaattagcgggtccggtacgacggactctcttgacaaacagtaaaaagccctgtccggaactgcgtggtctgacacgccttcccggacagggctttttcggatcgcgttcgtaaagccgcacagtatggacgccggcgccatgcagtacagtccttcgtcactcgtccgcgcggtaaatggcaaacaccgtactcaaacgggccggatacgattccatgatctcgccatcatagacgattcggatctcatctcccaccttcacctcgggcacgccctctgcggatatgacattcgtcggcacggtaatgcggtccgctgatttccgttcttcttccccttcatccggctccaccagaaaatactggtccgaaatctccagcaccatgccgcaaaaatatctctgtcctgcttcctccgaagtaaaaagcatcacacaaaatacaccagcgatgcagagaaacaggattctcaaactatttccatactttttcatagctagatcacctcagtaaaaaacatccgtccatcagagtccgtcaacacggcctttgcaccgcggaaccggtaactggaaagtaagagcggcttctccctgaaaatcacatccgacggcgcccggctgcccaactgatccccttttatctcataccggtaaaactgggaatgcctgccatatccgccatccatgataagagcagtatgacttcggttgaccagaaacgcggaacatccttccgccttcgggcggtagatgacatccctcttaaaatcagtcttcaccagatgaaactcgtcgtaataatagaaccacagcgcgccctgttcatccacattcatcgcatagcagtcatagatcggatatttttgattctcccacaaccgctgtccccgggcatcccatacgatcagaccgcacgcgcccaccggctggtcccagccgaaattaccgaacacgccctcgtcgaagtatccggtaatgatgcggccgtcttccgtcacgatacagctctcgattccgtcacccaggcacatctctgccagctttgtgccatccttttttaagagaactccgttattctccgccgtcccgtctttatatttcctgcaccgggcgcctaccagaagaatatcttctcccagaggcatgacgtgatgaaaattcatctcatgaaaccccagcggatacatctctccccccagcagcgtcccatccgtccagtttacccagaggcacagcgcatggtagtccgtattcgcctcagtatccacaaacatcccgttgatccgttccggcaccgaacgtgcaaacagaagccatacgctgccgtcgtaaccgatcgtatcattcacaaaggtctcatgttccagtccatactgcttctgcagcgcatttctctctgtatagctggtcacatatatatttctgtccatcccaaatccccttctcacacggttataaatcggttataagccgcttatcattcgcgtgtgtctgcacttataggccttcacagcctcttccagcttctctaaaaaggcttcctctccgaatgtattgagcttaaagaacatggcctggcttccaccggatgtgatggcagtcagcctgagttccccttcatatcccagaatcgtcacattcagactgacgcggttgcctcccatatagctatacctctcatataccattgtacagcaccgcacaccgttgatctcctcctcatgctcgtcttcgaacgatgcggatacactgccgtttaaaatttcattttttaagtattctttaaaatggtccagattccctgttaagtcagcttcaaattttgccatgtatctcactcccttctgccgcagccggcgtatcatcatagaccgcgaacggcagccactccaccggctctcctctgttctgaatggcatctgcaaatgcttccacttcttctttcgaattctctaagagtccaaatcttcccggtttcaattcgaaccgtttcatcagttcttcctgaagggaattgcacaggtacgtgtggaaacctgagatatcccagccaagaagatcaaagccgaggaatcgacgttcttcggttccagtcacttctttcttttggattatcctgtcctccagagacggcaggagcgcctcttccagcgcaatcccgatcaggcggtatcccggatccacacccctccgattataaaaataacgcctgtatatgtcttctgcgtcctgtttaaacaggaaccggctgtctgtatccagccggtcctccccgaacagacgcagggtttcttctgaaaaatctataaattcctgtttctccatcccaagccgtttccggtatttctctttttgcctttcatcactggtcatgcaggaaaatggctgcggctccgcatcacagatgcagccgctggcagtcagaatccattcggaaaaatcctttagaaattccgggcaccggcagggacgtatgatataatagccataatctacatacatttctgtgtccttccttttctggctctattttaccagatattattttcccatgtctttcattttccttaatatttacgctacaacatttgtcatataagtgaaagaaaataaaggtatggaggaaatattctccatacctttttactctcaattatacttaacagatcacttaaaccataaatgcttcaagttaatgacaccctttctgccattttatataccaatcagggatattctttgacactctgacaatctccccgcttttatatattgcaaaccggcgaaattcatttgtgttatcatataatgcagccaagtcacacaaatcaattatttcgtgaagatttctcaagctttctccaaatctcttctcaacatccttgtctggtatcccatgccctcccattttcactcgctctgcaattctctgctttgcgatctctggagaatcaaccccaacatagtgtaattctattccatatcccaactgtttggccctgtgtattgtacgcaatatagtatgtccgcacagagtagtctcctggttaaacgtaatcccttcctgcaagtaagaatttaatcgttcaattgcaattctgcctgctttcattaaatccgcagtatttctccaatcaccaaaacctctcaatatttcatcagtattgatccgtggcatcgtatcctgatagtgtgtagtcctgtataaagttgatttccctgccccgtttacaccagcatataaaatgtattttttcatttagaacctcttttgagctattactttcttttgctttctctgcaaaataaaatcacttaacatagaaaaaaaatcctgctcttcttctgtctctgcatttaaaaccaactccatagtttcgtctatatccatatctttacattcctcatataatttctttgcagcttcggccttcgacataaatttttcctccttgttctaaaaaaacagaagtaacgctgaaagtcaaatttatcgacctttcagcccttcaattaacaccaccaaatttgatggtgatatcttctcgggttctatctttcacttcattcacaccactgcgcaagcagcgaatcggaagtatgtcattacattacatgttaatgcaactgtaatgtttattatacaagaaaaagtgttaaaagaaaaggcataaagttttttcttcccctctattttctttgcatttcatgcttaataccgcacttccaagacccattcgccgcttgtatatccccttctaaaatgatatactggtaacacttagcgaagcatctttaagctaagcgtgcatcttaaaatggtcttaaaggtgtgtttcggcaggaaacacagcagttttctaaaaagggtgagaatcatgtgcagaaacaaaaagaaaaacaacgatgtattgctccatgcaaagccggcagaatcagcgacatttgcatggagtagctgcagtcgctgatcaagtacggctttgctgcctgacaataaaaaacagggagtgaagcgctatgaaatatatcaatgcggccgcggttcttcccgcctcgctggtggaagagctgcagaattacgttcagtccggatatctttatgttccggccagggaagaccagcacagggcctggggcgaacggaacggaggccgggaggaactgaggaaacgcaacaaggatattcttgatgcatggcagaatggagtgtccatggagacgctggcggaccagtactgcctctctatacatgccatacggaaaatcatttatcagaaataatcatggaaggactgtggaaaacagtccttctttttttgtacaaaacagtacagaagcgactggtagattgagatttcacggaatttcgggtatccttaacaggaaggatagaaagaaaaaaactgaaagaaaagaggttgttacagatgaacacttacgagactgcgcggatgggatatggggaagccgatatcacaccggatactgttgttgaactggtcggatttttccgtccggacaatcactcaaggggcatccgcgaccccttgaagctccagacaatggtctgggaagacgggggagaaacggcctgtcttattaccctggacagccttggttttaccgtccatttggccaatgccctgcggggcctcattgcggacctgcttcatacgggaaccgatcacgtcatgactgcattttctcatacacattccgccccgaacgccgcagaggagcctgaatactttgatttcgtatgccgcagggcgcagagtgccgtaaaagacgctctgagcagtctgtctcctgccttggcttcatggggcatcggagaaaatactgtgggattgaaccgcagaacggattccaccgacttcgacaaccggcttggaatcctgtctgtcaccgcaccggaaaacgaatctcccagggtgctgctgctgcgggtcactgcccatgccaacattctctccagcgacaattatctcatatcagccgactactttggcattacaagagagcagttggaagcgcgcttcggctgcaaaatcatgatgatgcagggcgcctccggagacgtacggcctcggtttcatcaggaaaacacagagtatctggagcttcacggcttcgaggcagcggcgaagggattttcagaagagtatcagaaaatataccggcttcagagccaaaaggccctggagcagacggcagaggctatctgccaggccgtgtcagccgttcttcccacaatggaagcggagcctgtcactcatctgagcatgaagtcggttttcagccattttacagcggatgttccctccctggcacaggcggagcgaattgcctatgaggcgcttaaggaggccggtatcgatggaaccgactggctccgggaagtgaaacgccttaacggcgagggtatttcacaacagttttcagaggtggaaatacagtacttttccctcaatgacggctgtctgtgcgggattgccaatgaagccatgtgcaggatttccattgacgccatggaggctgcaggaacgccgctgctctttttaaacggctataccaatggatgtaacagctacttaccgacgtccggggagtatgagaaaggcggctatgaggtgctctggtcaaatctcgtatattttccataccacggccgggtcatgccctttaaccgcgatacggccggacagcttgttgaggaagtggttcgaaactggagaccgctccgtgcagaatgaggttataaacggaaaggcggtttactctccctatagcgaatcttctccgcacgctccgatttccggtgttcgcctctcgcgctgcgctcatactgccggatacaatacgccttctggcccgctgccggcgtaaaatccggtctgctgcgctcctcttccagcgcatcggccggcgtctgtggacggcagctgcaataagggcattccggatcgctgcacgtcggatcgatccactggttacagccggggcagcagaccgcgtcatacttaaaaaacagaatcagcctgcccccacaattctcacaaaagcctcccgcatacgttccggctttcagccactggtttataaattctctttgttttttgaaattcttcgttttcttcttcatttaaattcttcgttttcttcttcatttattttcaggttgggccggaccggcagcactgtatcatcaattgtgctgtgcctgattagcctgtgaatattctgtatgtggatagaaaccgctaaaatactgattccattcccgctgtttctgtagtaaaataaaggatggcgcccttgcgcactactgatacaaaacattgatcaatgactacggagcggatttactatggaaaaaagcacgtcttcgaccctgatgacagaggggtccatctggaaaaaaattatcgcatttgctgttcccttatttctcgggaacctttttcaacagctttacaatacagcggattcactgattgtcggcaattttctggggagtaatgccctcgctgccgtcagctcttccggcaacttaatcttcctcatggtaggtttcgtaagcggcatcgcaatcggagccggtgtggtcatcgcccggtattacggcgccgggcggcacggtgacgtgcagaaggccgttcacaccaccattgccttcggtcttgccgcaggggcggtactgaccgtgatcggtgtggtactggcgccgattattctggtctggatgggaactccggcagatgtacttccggaatccaccgtctatttccgcacgtattttgcaggctccctgtccttcgtcatgtacaacgtgtttgtcggcatcctgcagtccgtgggtgacagccgccatccgctggtctatctcattatatcgtctttcatcaacatcgtgctggatcttgtgctggtggggatctttcactttggagtgggggccgcggcgtttgccaccattatctcccagtttgtcagcgcgtttctctgtctgcgccggctcatgagaagtccggaggaataccgggtctgcttaaagaaaatccggtttgacacaggactcctgcggcagatcatcgcaaacggtctcccggccggtttccagaactccgttatttctctggctaacgtagtagtccagtccaatatcaaccgtttcgggaaaatggcgatggcgggatgcggcgcctattcgaagatcgaaggcttcggattcctgccgatcacctgctttgccatggccctgaccacgttcgtgagccagaatctcggtgccggacagtatgagcgggcgaaaaagggagccagctttggcattctctgctccatcatcactgcagagctcgtcggcattttcatctacgccttctcgcccctgctcatctccgcctttaacaatgatccgcaggttatcataaatggaacggcccaggcccgcacggtgactctgttctattttcttctggcattttcccactgtatcgcgggaattctccgcggcgccggaaaatccacggttcccatgctggttatgatggtctgctggtgcatcatccgggtgacgtacatcaccgtaaccgttcactttgttccggatatccgcgtggtattctgggcctatccgctgacctggttcttaagctcggtcgtatttctccgttatttcctgaagggcagctgggtgcatggctttgagcgctagtgcctcccggcgcgaataccagagcgtgtcacatttttcgaaacacaggtatgtacaggatgagtgtcgcagccatgaccacggcgcagacagcaatcagtgcattcgccgccgcggccgggatatgtggcacgagaatgagcacaaacatgacgacaaacagcagcgccgtgcacacctttccaaaccacatggcgccgtcaagcttcttgccctctctcagcttcaccaggcccataaccgccatgaatccctccttgacgacaaagagtaccaccagaactgccatataaggatagcgggtccacaggcataagagaatggccccgtgcgtcatcttatcggcaaacgggtccagaaatttgccgaattccgtgatcatattgaattttcgggcaaccagtccgtcaaacatatccgtgatggacgatattcccatgacagccgccgcggcgtaatagcctcggtccgtctccgcatggagatagagatatacaaagaccgggatcatcagaagccggaagtatcccataaggtttggaatggataacagttcctttctcgtatattttttcattttgcatcactcctatccggcgatttcgcatcgccagccagtaaattttgtagagaccttcggatcatgcgctccatctcacaggggcttctctccggttcctcaaaaagccatttcatcataatattccataagcctcccatgttaaaaaacagacagtactccagctcttctccgctcatggtttctttccagtactcttgcagccggccgtaaatttcgggccagtacgtattggacacctctgtgatatgcgccgcaaaataggcggtatcccgttccagataccggacatattccctgcacaggcgttcgcagcagcttcgaaacaggtcttcctttgaggaataatttctataaaatgtccgccttgataaatccgcccgcctgcatatttccaccaccgtgatctcttcgaatttcttttcctccatcagagccgccagcgcgtccatcagccacgtccgggactgccagacaaccggattgctcgtctccttcatctctccaccttcgtttctctgatcctttttaccggattattttcagggtggcacaccggcccccctgatgtagcacttgcccgcagggccttgacgctgtcagatacccgcattatactatggaatactttccgttacaagtacaggaggatgaatgacatggaaccaatccacgaaaatttctcgtaccggcacgcggtatccggtggggcagacccggtcccggccctcatttcccacaggagggaacgtctggccgcggactgttcccgctgctgcggcctgtgctgcacggcgctctatttttccaaagcggagggattccctgacgataaggaagccgggattccctgcgcccatttatgtgaagatttctcctgcgaggttcacagctccctgtccggacgccgcctgaagggatgcatcaattacgattgcttcggggcggggcagacggccacagaaatcgtatttcaggggaagagctggcggcagcttcctgatccggaggaaatgttccgcgtcttcttccttgaattaaagctgcacgaggccatgtggtatctggaggaagccgcaatactgcgccccgcatccgcactgcgcccccgtatccatgcggcgctcaccggcttagagaagctggcagacggttcccggcaggacctcacggaagacgggatccacgataggatcactgcggccaacgatctgttgaaggaaacgatccgcctgacgctcgattatgcggcttctcagaagctgccttcgaaaaagggaggcatttcgcggtctgcccgcagccactccgcctcttcccataaaactcccggaacgaatggcgccggaccactgcgcttccttggatatcattttcagggggcagacctaagtgccatggatttttcttcttcctttctcattgcggccgacttgaggggatgccgtctcttcggaacgtgctttctgggaaccgatctgcgggatgccgatcttaaaggcgccgatttaagggatgcctttttcctcacgcagatgcagataaatgccgcaaaaggcagccgggatacccgcctgccttcctggttaaagatgcctgatcactgggaatccggcagataaatcgtgacatttcctgttacaataagtcagtcctgtccgccggaacatttcgccgcgtcaatggcgagtacgatcatcagacagaggagcgcgtcctcttcccttacaatatcgagaacgtacgtgtctgaaaagtggagaaattctttactggccgtcatgatcagactgcctgcgctgtcttttacacgatagtcccattccagccagtctccgtccactgtccagccattgcagtccagcgtgaatttgggctttaaaaaggtcagttccttgcggatttctccgatctcctgtccgtttatgtacatcagaaatttaggcagaaaggtgagcactctctcctgtacggttccgatatggttatcgaaacggtcatagatttccagcaaatggccccagcttaattttccctttaccgtatagaccgtatttccactctcgtcatagatgtcgtaactgtcaaaccaggaaaacagccgctgtttaaatagtaattgcatgatcgttcctccctgttatgagcactcagcggtttggccgcttcgtgcagtgctgctttatgccccttcattttgggggataaattttgccatgtaatactcatccgcgtaggcgccgccgacacgcatggagttctttctgagcccttcgattacaaaaccgctcttttcatagagatggacagcggctttattttcctttctcacggtcagctccaggcgggtgatttcctgggatacggcccatgcatccaggcgtttgaacatctctgtgccgatgccccggccgcggtatccggcccggattccgactaccacatatgccgcatggcggattcggcggcagcggccccgctcggcggtcagaactcccgccatcgactccccttccctggcaatcaggaagaaatcgcctgctgccagagactcccggatcatggccgcggcggcctccgggtcatttttcctttccccgggttccagcatcatcatatcggtctctaaatccagggaccgcatcatttccacatattcccgggcatcctccggtctgatctgacggtactccatcgatccgtctcctccatttccgccataaaggcagttgtccaattcctgtctgtttgtttccacaagcagtcgtcagatggacccgttagcgagccatctgactcgttgcctgcggatccatctgacgactgccgcaagggtcaaaaagtccgctgcctgcggcgctttttgacttggcacgggtcacagccactccgtcaccttatcgacgaagcagactccgtctaaatgatccagctcgtggcagaaacatttggccatctcatcaattccggtcagagtgacctcttctccattttcatccagcgccttcacgattacggtctggggccgaatggtccttccgtatttctccggaaagcttaagcagccttcgatgcagtcctgttcccctgtctgttccacaatcacgggatttaccagcttcatgagcccggttcccatatcgatgacgacaaggcgttttaaaattcctacctggttcgctgcgattgcagctccgttaggcgtcgcatgaagtgtatctgtcatatcgttaaggatttcccggatccggtcatccacctctttcacttctttgcatttctttctcagtatctcgtctccgtcgtaacgcatgtttaatactgccatgattccactctcctgcatttatattttattcgctgcagcgtctgcccatttcaggacggctttccccatcgtttcccggtccatggtgtccacacgcagtacatccgtgtcggaacggtttaagaaccactcccgtttcaggggaagaagatactcccggtgaaaatcaaaaaattctctggaccggctcttatctccctctttccgcgccttcagcgtctcctcatctgcgtccaggaacagaatcctgtccggcatacagcgtctcaccgcctccagttccctgcagagaggtccttcgatatcccaattttcgcctatagacttcgggtaattcagcgtgtagaactcgatctcttccgcgccaaaatccatcaacaccagtttatgctcctttgccgctttccaccgctccacttcatgattcagccaaagcctctgaatctccaggtaatcctcataacagttctttatgaggcctcggcggtgtacctcactaataaccgttccattgtcctccctgcttaaaaagatatcgggacggcgctcctttacatactgaacggccgtggtttttcccacggccatacagccctgcagcgatagaattactgccatataccgttcctccctacagccagatatctcttccgttccatgtcacactctctgcatctccgtcgtcgaggcaccagcccaaaaggctggccacaaatccaggcgtaacaggaaaatcttccataaccggctcgtcggctttctctgtatcctggcctgcgtcaggctccttcccggcgcccagtttcggaatccggtaccgctgccagcagccgctcgtcgttctgttcttaaatactcttccgatggataccagataccgccgctccccatgctgttccgtgggatagagcacaagcagccctttatcctccgacgcgatatgcagtacgggtctgtcataatcatcatcccgctttacccaccagtaataggtgctgtccccatagactaatgttcttttatgcttctttgcaattgccacaaaaaacctcccggaatttctccgcgctattccagccgcttttcctcctgctccatctagtactgcattgcgtaaataactgtgatatagtgcccgatatctgcgtcaggtgtgcgtccgcgaagcgacggcgtagtggaccctacgtctagcttcgtgggcgttctcctggcgtagatagcgggtgctatatcataggaatttacgcaatgcagtactagcggcggcacacagccaggacaggatacagaatgacggccagaacaaggcctccaaggccctgaatcaaattcgacggcacgctggccagggccgctgccattccataaaaacaggtttcatagagccagtacccgcaggctacaaacaccatgtcagtcagccctccgatcaccacaccggcggtccgttttccggccgtcgccgaaagtctctgaaatacaaggccgcagcaaaaagcagtcagccccttaatcagaaaggtggccggcacgtacagcagatatccgcccaggaaatccgccagcgcggaaccaattcctgcggccaggagcccctgaaccggtccaagaaagattcccgaaagaatcaccagcgcatctcccggatggatatatccgttcgtacccggtgtcggaatccggatcaccatcgtcgctgtacataccagcgccataaacagcgccgtcatcaccatttttctggtattattgttcgttttcatacaaagtctcccttccggttctcaatgataatgcacttactataaaccgaaaatggactgtttcaaatatccagtttttaactttttagcaatgccagttttattttccagccacacgcctgctccaccactgttttattgtatcataaacataaaattcgtgaaagacctcattcggtgtttcgatgtacttttgccctgagttgttacagttcacggcactggaaaaattgcctctgttctgtgaattttatatattttttgaaaaggggttgaagtataaaaaacacttgctacaattaagataacggcgccgtaataaaacgaaaaaggacaaaaaagcatgaacaatctcatagtaaagcctgtcggcaaagttgtatttcagaatgaaatgccactcattttattggaaaagccttatcgctccgccctggagggactggatggcttcagccatattcagatcttctggtggttcgacgcctgtgacaatgaagcttcccgcggtgtgcttaaggtcagctctccctaccgcaattcgccggagacgctgggcacctttgccacccgctccccggaacgccctaaccctgtcgcgctctcaacggcgcagattcttcgaatcgatccggcggccggcatcatcggactcagccatatcgacgcacgtgacaacacaccggtcatcgacttgaagccctatactcccagcctcgaccgggtggcgcagccctgtgtgcccgaatggtgcgcttcctggccaaaaagcctggaggaatcggctgatttcgactggtctggcgtatttacattctgagaggtggcggccatgagtttaaaagactatctgatcaaaaaaccggttcttgaaacagaacggctgattttaagggagctcaggccggaggatactgacgatttgcgggagtggatgagcgatcccggcctgtacctctattggggaaagcggcccggcagacacgatttaaatccggaactgcttttcacagccgccaatcagaaaccaacgaaaagcttccactggggcatcgcgaacaagaaagacaataaggtaattggggaattctgggtctacttaatcgagaacgaccggatggccaaggtctcctaccgcctctcgcctgcctgtcagggaaatggcctcatgacggaagccctgaaaagcgtggtgaatttctgcttcactcgcacggaacttcagaggctctggaccgatgtggacgtaagaaacaccgcctcctgcaaaacgctggaaaaagccggattcacacgggagggctgcatccggcagggaaaaatggtctcttcctggtgcgactactatttatacggtatgctgaaaacggaccttctcccggaacacgccagtcaggcgtaacccgatccagacagattaccggactcgcgcgccggggcatggccgcttcagcagccatatccccttagggcgtggattgcagcaattaacagtacgggctttcctgtcaaacaaacaatgcctgcgtcatacctccgcgtttcagctccgcggtgcggtatgatgcaggcatattctattctttgattatggaaagcatgacggaaatatcttcagccgccatttcggccttcgacttttcaattaaaatattttgcccggtcataatgtaggaaggcataatccggataccctgataccatatttcactctttcgtatcttataggtggacaccgacggaatcacatttttcccagtggcctttttgcttatcatgttaaaggcctttttcgccacatcccccatcagcatgattactttcacatggggaaagagagacagctcccactctagatacggcagacttttttcgatggtgcttctctcaatggccggggccgtcttcggcattttcactgcgtttgtaaggtaaataccctgctccagcagttctcccgcattgttcacctgtgctccggccttctgaaacagcggaattgccgtcgataaataggccgccccgtcaccgccgtaaaagtcatcagccgggtttgatggcaccacttcattaatcaaaaccgcccggatttgctcgggcttcacctctaaatcctgaaatacaaacgcctcttgattaccatttcttttttccatttcttctctgatattcatcgtttctcctcatagtgctgcagtgcagacttcagtctcttttccacctctcgcttcaaagaaagcggactcaacacggtaactttatctccaaaggacatcaggaagccgtacagccactcattgtccggcataaccgcccggacagtaagttccccgtcacattccgtaaccacccggtcatcgaacacgtcatatactctggaggccgcttccttcgggaaacgcagaaccacagagacaggctctctttccttctcccatcgtgtcagatccggctctgttccttccggtatgcgatcaaacaggatccccgtcagcacaatctccttgatccgcgataaacggaacagccggaaatcttctctgaccaggcaccacgcatacagataccacgccttgtccttatagatcagcctgtacggatggcagtcccgttcactggccattccattggagccatagtacttaaaatggatctgccgtctcgccataaccgcctgtttcagcacgttaaaatccatccgttccctctccgggtcgcttccccagcgggaaacatccacttcaatccagctcgtatccgccatctgaaacgcagccctcagtttcgataagaccgtctccatatcagaattctgaaccgccgccagactctgcaggccgaacagaatatccctcatctcctcttccgaaagcagcgatctctccagcacaaatcggtccagcaaacgaattcccccgcttcgccccgccaccgaatagacaggcacccccgccccgcttatcctatcaatatcccggtaaatcgtccgcaccgacacctcaaacttctccgccagctccggcgcagtggcctgtcccttttccatcagatggtaaataattttgaacagccggctctctatcattgctatcacctcgtttttcatcatatcagataaaacctgacatgctatgtcagcaatattataattgtacacttttaattaattattttatcttttgcttttatcttttgcttttatcttttgcttttatcttttgcttttatcttttgttttttatcttttgctttttatcttttgctttttatctcttgtttttatctcttgttttttatcttttgctttttatcttttgctttttatcttttctaaattcaagatttttcttaatccgcggtgtgtccgttctgccccggcagactccgttttctgtgacgtttgcaggctgttagaagctgttaatgcgtggggtttttcgttctgccgcaaagtgcggttgtctgagcgcagcgagttccaaactttgcggcaggcttttagaaaaatcccacacatttacagcttcttactgccgaaacaggaacagaaagcggagtctgccggggcagaacggacacaccgcggattaagaaaaattacctcttgaccttatcacagtgggaaggtgtacaatacactcagaaccggttctacacctgacaacgcaatatcagcacaacaccatttcacttttgggaggttcctatgtttaccattggagaattttcaaaattctgctgcatttccgcaaggatgctgcgccattacgaccgcatcggcctgctgcatccggccgccacggatgaacagaacgggtaccgctactatgacagcagccagatccccacatttcagcgaatcgagaagctgaagcaatacggcttctcactggccgaaatcaaacggctgctgacgcttacggaggcagagttaaatatccagattctgcttcagtacgagcgcgtaaaagagcaggcggccagtctgacggagacgctcacctgcatggaacgggatatctcccattttaaggagggcataaccatgaatcggaactatcacgtcattgtcatgaacacaccggagcagcgcgtcttctccgttaaacgcaccattgccgtcaaggcccaggacattcacggcctcatctctgacctcatgacacaggcaaaggaacgcggcctgcaccgcgcgggtccctgtcagctggtctacatgggaaatgaattcaacgaagacaggatggaggtggaagcacagcttcaggtagcggaagcgcatccggacacgaagcttctgccggaatccctatgtgtcaccgcgatccaccaggggccgctggaggaggtacacaccgggtatcaggcgatcggtcaatatctggaccagcatccggaataccagcttaccggaatcagcattgaacggtatctaaaggatgagaatatggtctcttctgcggaagaactggagacagcgatcctgtttccggtagaaaaagcgtagtccgtttccatcatcaatatcaaaaaatgcgggccggaaaatatggcaggattttccggcccgctttcttctgtccagcggctcttatattttcgcttattttttcaaatatttgatacagcacagaataaaacagatcagtgcagccaattttgccaactgcagcacagcggtaaaaatgattgagatcaggggtaaaaactgagcgattaacatgccatctcacctctcttttcctaacttttatcggttgtcagttctcatttccatggcggccgggcctcgtgccttaagtgtccactttcctgctgtcaaaatagacaaaccggtcgatggcttccaatatgtccttaaaatcctctctcggcgccagctccatgtactttctcagaatctccgtctcccgtttcttatacgggccatagaagatatcatagaggttgtggcctctcatataaatcttaaactcttccatatgcgccttcagttcttccacagatgagagcgtccctcccagcacctctgtcagatggcggcctgactgcaggcggtataaatactcctgccatttggaaaagagcgtctcatagaatgccccctcgctcttcacaattccaagctctgccataatctttggatttaagaagtaattttcaaaggaatagtacttaagaatcagcacatttctcctcgtaaccttcggcagcttatcgacatcctccaggctccgctcgtcgtagtaccggcagagctggcccgccagttcctccgggttctttccgtcgccgtcgcgtatcatcagaaactgatcccgcaaatacacctgattcatgtattttaagttggcgtacgtcttgatattggtacagctgttggtggtgataatcgaaatccgggacagattgccgttagcatcgtgaatctccgaataatacttctccagcagcagcggcagccggctcttatcctgttttccctccacgataaagacgaagctcacgttcaggaaatcgttggccccataaccgagatcgtctaaaatggcgtcgatatccgtgcgtttgcgcaccacggaatagtcttcctcgtccaggaccacctggcggatctggcggctggtaaagttaaacagcatattcggcgaatgggtcgtgaagatcacctgattcttcttcgacagctggtacaggatctcactggatattttctgcagatgaggatgaaggaaaatctcaggatcttccacaatgatcacgctggggatccgtttctcatcgtccgtgtacgtctgaagcagcgacagcatatagatgctcttcatgcccccgctgagattttcgatggggttcagccgcccgtgttcttcgtggtatgtctccgccgtcacatggaacatctcatccggattgcagttcaaggtgaacttgatttcttcgaatccgccgttccttctgtagttggcgttgaccttctccgtaaactcttttaaattaagctgatacatcttatattccagaagcttggacgtctcgtaaagcttcaattcttccggttttttctgattgatcagaccgatgcatttgaaacactggttgcactcctttgccgcatcgaacatgcagacgtgggcgcgcagtctgatcagctgctcatcctcctggaacatgaacagatcatcctgaaactgttttagctgacgctcggtatcgatataataaatcctgggaaatacctcctggatataccggttgttcttcttatatccatcgaaaaagcgggactcccccttccagtttaccacaaatgtaaatgacagggcttcctcctcatacgacggcagctttgcacagaaatccctgcgccatgcgtcataccgcttgtactggctcacgattcccgcccggtggaacatatgaagatcttcctctgtaaaattcagggtgatggatatctcaatattctgttttctttcattaaagtcgttctcccgtatctggtaagaaccggccaccgcacggatggcatccagcaccgaggtcttccccgtgttgttctttcccaccagaatcagggcattttcgataccatgaatctccatctcacggatggatttaaaattcctgatgtggactgatgtgatctgcatatgtgttctcctttaggtttaagtataggagatgccagggcaaatttcaagcttccgctgaaattttcgcaactattgagcactggcccttcccgcgcttcatactatggattatattctaaattcaggagtggttcttatgttcgattctgccgtagtgctgacccctctgcactatgtttatctaatcggtgttcttgtaatactcgctgtcatggtcctgcgaaaagacacccccgccgtctgtatcgcctttttatttctcctcggagtcatcggtcttggttccataacaggcggaatcatgaccgtatttaattctattctgttcgccgcgaaagaattcatggaagtcatagccaccatcgccctggtaacggctctgtccaaatgcttaaaagacttaggcagcgaccacctgatgatggtccccatgtcgaaaatcatgaagaccccctccgtcacatggtggattctcggaatcaccatgctgctcttctccctcttcctctggccgtcaccttccgtggccttagtcggcgcgattatgctgccatttgcagtcaaggccggtttaaaaccgctcgccgcggccatggctatgaaccttttcggtcacggaatcgctttaagctatgatttcgtcatccagggtgcgcctgccatttccgccggtgccgcaggaatctccacatccgatattctcacccagggccgtcccgttttctgggtcatgggcattgtcaccgtaaccgccgcatatcttttaaaccgtaagagtatggcagccacagagaccgtgtccgcagaggccctgcctgaggagcggaagaaagtgacgaaagcggccatcgccatcgcggtcctcactcccgcggcctttctcgccgatattcttctgatgctggcctttgacctaaagggcggagacgccaccagcatggtttccggcaccgccgtactggtgatgtgtgccggcgcagtcgccggatttggcagacagtcgctggaaaaggtgaccgattacgtgacaggcggcttcctcttcgccatcaagatcttcgcccccgtcattatcatcggcgccttcttcttccttggcggcagcggcattaccacgatcatgggcgatcagtaccagagcggcatcatgaatgactgggccgtctggctggctcacaatgcgcccttaaacaaatatatggcagcctttatccagatggtcgtaggcagtctgaccggtctcgacggttccggtttctccggccttcccttaacaggctccctggcccacaccttcggcaccgccgtcggcgcttcggtaccggtgctggcttcgctcgggcagatctccgcgatcttcgtgggaggcggtaccatcgttccctggggacttatccccgtggccgccatctgcaacgtcagccccttagacctggcccgtaagaatcttccgccagtcttaatcggctttctctttgcttttttaaccggctgccttctgctgtagcagtaacagtaacggaaatacgtatcctgaatcacgctttatcaaattgcacttattgaatcacgcatcttaatgaaatggaggaatctgccatgtgtggaattgcaggcttttataacccgcatcgcaattacttagaagaggaggcccgttaccgggatatcttaaaagacatggccgcggtacaaagacaccgcggccccgacgattccggcgtctgcctgagcaaacataccggtctctcccacgcccgtctgtccatcatagacttagtcagcggacatcagcccatggaaaaggaggctggaggccgcacatattccatcgcctacaacggggagctttataacacggaggagctgcggacggaactgcgcgcgcaggggcactcctttgccaccaccagtgacacggaggtgattctcaccggatgtatcgaatacggtcccgactttgtcaagcggctgaacggcatctttgccatcgccttttacgacgccttgcacgaccgtgtcatcctgttccgcgaccgggcgggtgtaaagccgctcttctacacggtccgcggcgacgagatactgttcgcatcggagctgaaaggaatcctggctgtccccggcatccgacctgaactggaccggaagggactgaatgaggtcttctccatcggtcccgccagaacgtatggctgtggtgtatttgccggtatggaggaagttctccccggccattttctcatctgttcccccgagggcgtctcttcccactgttactggaaattagtgagccttcctcatgaggacagctacgaaaagaccattgagaagacggcctttctcgttcaggactctatcaaacgccagatggtctccgatgttcccatctgtaccttcctctccgggggagtggattccagcctggtttccgccgtctgcgccgcggagcttaaaaagcagggaaaaaaactgaccacgttttcctttgattttgtgaacaatgataagtatttcaaggccaattccttccagccctctcaggaccgcccgtttgtggaccggatggtggagtttctggactccgaccaccactatctggagtgcggcaacaccgatcaggccgaccgtctctgtgattcggtgctggcccacgatctgcccgccatgggagacatcgattcgtccatgctgcatttctgctctctggtcaaggagcataacaaggtggccctgaccggcgaatgcgccgatgaaatattcggcggctatccctggttccacaaggaggaatgcttccgggcccacaccttcccatggacgatggacttagaggcaagaaaagtccttctgaaagatgattttctcgattacctgcagatggacgaatacgtcaaagaaacgtatgagcggtctgtcgcagagactcctgccctgtccgaagactcgcccacagaggcgcgccgccgggaaatctcttacttaaatcttcgctggttcatgcagacgcttttaaaccgcatggaccgcgccagcatgtattccagcctggaagccagggtgccgtttgccgaccaccggatcatggaatacgtctggaatgtcccctgggatatgaagacgagggatggcctggtcaaaaaccttctgcgtcagtccgggaaaggccttctgcccgacgatatcctgttccgcaggaaatcgccctatccgaagacttacgacacgaattacgaaaaactcctcaccagccgtgtcctcgaaatcatgaacgattcgtcctcgcctgtcatgcagtttctggacagaaaaaaactggagacgtttcttcaaaatccctccgattacggaaaaccatggtacggccagctgatggccggtccgcagatgctggcctatatacttcagatcgattactggatgaaggcctataagatttccctggtttaagactctggccgcgcacactttatatacatttaataattttggtgattattttccgacaaattgtattgtaaaatgaaatattcatgttataatatttttagacgtttttacacttagaaaaggggaataatatgtttggttcatcaaaaggagcaacaacagaagcattagaaaaactggttcagaagggcaaatgggataagattaagaaaagttatttaaattctgattcagagacaaaggtacatttagcagaagcatgtgcttcagccgtgggcgacgattccagcaatgtattgatggcactcctcgactcacccgaagatgaagtaaaagtggctgcacttaaatctctcgcaaaggtcggcaacgatcactgcgtgagccgtattcagcagatgatcgcttccgtaccggctgacaaaacagcacttcgcggagaaattcagaatacgcttcaggcacttcgcggaaaacagtagagcagatagcggcaaaactgacaacagtaaaacagcggcacacaatacacgtggccgctgttttctattaatttagaatatattttaaaattcattacttcccgccatgctatttcggaaattttacgcctgctccatctcctccgtcacgctctgcatctccttcgtatcaccgatgagaatcgctccggtcaatctgccattcgcataataccgggtcttatagatcttcttttccgggtcttcctcgtgcttcaccgtatactcaatttcggaattctttcccacgtcgcccacggcaaaaagggaagtttccataccgttaaaggtaagtgctgcgggtacggtgtggtaaacaaggccgtcgccggccgcattggcgcccgctgtccggcccatctccaccgcctgcggccagatcgcatagttgattccctcatactcggcgcagtctccgcatgcgtatacggacggaatggtggtctccataaatgcattgaccttgacggctcttccgatctccgctcccgcgtcttttgccacaccgacatttgcacggacaccggcagatactaccacaagctcagccggaaccacggtgccgtcacccagacgcactcccgtcacatccgtctctccctcgatcgcctcaatcttcacatttaaatggatggcgattcctacattctgaatcagatccttcaggaattcaccggctcccgcatccagctgacggcccatcagctgcggcgccagttccagaaccgtcacctccaggcccgcctttttcagttcccaggctgcttccagtcccagaacaccaccgccgattaccacggcgtgcttcgtctgaggaagaagggcgcctactttttccgtatcggtgattctccggatcgctataacctgcggcttatcatgacctggaatcggtggaataaagcattccgaacccagggcgtaaaccagtttgtcatattttaaacggattccgtccgaaaaggtcacttctctggcctccggatcgatcttctccgccgtctttcctgtcagggttaaaatccggttctcctcataccacggtgcgtcgtgaaccagaagctgttccctgttgttctctcccagcatggatttcgtcagcatggggcggctgtagggcagtatctcctcattcgtcgccatcacgatggaggctgtggaattccgttctcttatggcctctgccgcgtttaaccctgccgcgccgcctcccagaatcagaaatatctcttccgtgtctctgtggaaggacttctcctcctccgtaaacgggacgaaattctccggtcccactccgcatacgggacatacgctcaccccatcttcaaataccgcgccgcataccagacattttaccagtttcttttttgtttcacccatgtgaatacccctttccaactctcatagtatcatttcctatatttattaaaatcagtattaattactattattataatatcacatttgtttttcttttacaagactaacttcggtgacgttcccaccacttagatttgtaaatcttgaagtgggggcttcctgttcaatggctcatcgagccaagtatctgcaggctatccccgtgcgtcccacggttcttttttgccggatacggcaattctttcagtgcggctacgcactttttctcagctcctgatacagacgcttcccttcttcacaaagattgattgctgcgttctgatcccggtccatctgattcccacattcgcagcagtatatccgttctgacagcttcagctccttccggatccttccacaacagctgcatttcttgctggacggatagaaccggtccacacggatcagtttctttcccctgtccttcagtttatattccagcttttccacaaatgccccatagccattgtcagccactccctggcccaagtgcagtcccctgctcatccctttcaggttcaagtcctcgatgcagatacagtcatattcctctgccaatcggtagctcagcttatgctggaaatcgttcctctggtggcggatcttttcatggaacactgccacacgccgtctctgctttacatagttcctgctccccttttcgcagtgagacagccgtctctgctcccgcgccagtcttacccgggcttctttgtaataccccggatagtccgcgctgctcccgtccgggaacactgccaggccgtgcatggcaaagtcaatgcccaggaaccgctctgcttccttctgttcttccacttgattttcgtaggaatacaggatacttgcataatacttcccagacggctccctcaccacggttacggatttaagcttccactcttccggtatctcccggtgcgccacaatccgcaccggtgtcagcttcggcagtttcagacggttcccgtccaatacaatatttccattgaccagatttgtcgtgtagctgtcccggtcgcgatgctttgatttgaaacgtgggaaaccggtctttgggtcagcgaaaaacttctgatacgcagactgcaggtgcagctgctcattggccagcgcaagggaatccacttctttcagccacagaaactctcccttgtacatggccggtgtcagcttcggacggcttttatccttctcataggcctccttctgatcggccagcatacggttatagatgaaccggcagcagccaaaggttttcttcatcaagccttcctgttcccggttcggatagagccggaaccgcagcgctttattcatgacttttccccctggttttctatgtaggcgcggattgtttcaatcggcgctcctccggccgtcagcagacagaaactctggctccggaacgcctctttccagagcttcgaacggatctccggatactccttcttaagcaaacgactgcttgcgcttttatatgcgttgatgaaccggctcagctcactcctgggctgtgcgcggaacatcacatgtacatggtcacagtcatgattccactcttcaaacataatgccatacatgggggcaatatagcagaaaatctcctttgcgcgttctgaaatggggtcgtcaattacctttctcctgtatttcacagccataatcagatgataatacatcaaaaataccgaatgtgcattattgtccaattctctcatagaatcagcctcctgtcctatatcgactgattctattataacacacttccagcgttagaacaagtgttcgtttttcttttttctatatcttttctatatactccccatcaacggttatgatcacaaaaagcagaaaaatcgacaccaaaacacaatatgaccataaaaccttgcaattcatctcaccattttagaagtcggagaattcttgtaattacatgttaaaattttgtaaacgtagacagaaaactgtaaggtcccctcccgtgctgtttgtgctaaaatatcagggaatggcagtcaaatgaacatgccagcatgttcacctggctcgctgccttcgcaagaataaaagaggggatcctattatgaagcagtatacgattggagacgtgtcgaaaagactgggcatcagccgcgactcgctccgtttttatgaaaaaaagggcatcatcactccgcagaagctggaaaacggctaccggtgctacagctatgaggatatgagaaagcttctcgacatcatgttctaccggaggctgaacttcagcattgaggatatcaaccgaattcttcatcagagttcctttggttcttattataccatgattcaggaaaaaatagcagaggaagaacgggaagtggaacggcaccagcgttctttgatccatctaaagtatcttactcagctttataagaatattgacgattatttaaatgattatgacatacgcccgctccgccgctattacaaggttgatgagactctcattgacaagctggccgttcatgatttatgctatatctatcaggaatatcaactcagggaaggcatgccgggtcaggtggatgaatactacttattcgccgcagataccgctgccatcatcggactggaggaacagttatccggccgcctctttattcagcatgagcggtgtgtctacacggttatcgcatccgccagccgcattccagacacccgttccatcatgaaggcggtctgctgggccagagatcagggatatacgctggaaggtacggcctacggcggatttctgctgagctgcgcggtcgatgagatgcagacagctgtgccggaggaggccgacgtcagccagccggtttattacatcgaactgtatctgccgttaaaggaataacagccgcgaaccgacgtcctttcctcagatgattttccactattgctgcgttatttatgcaatgcagtatcagagtactctcaggaactctttctatccagatttgtgagggtactccacgaaagagaaggaggatttaatcatgagtaagggaaaaggagtcatgcaggaattcaaggcgtttattctgaaagggaatatcatcgatatggcggtcggcgtcatcataggcggggcgttcagcaagatcgttacctctctggtaaacgatattctgatgccgcttttgggcgcagttacgggaggcgctgatttcgatacctttaagattgttctcagcccggctgtaaaagatgcggcaggcgaaattattaaggccgaagcggccgtccgctacgggcttttcttacagaatattctggatttcctgattatcggcgcctgtatgttctttatgatcaaggcggtagccatgatcagttcccgtctccgtcacgaagaagaaaaaaaagaagctgcaccggccggtccgacgcaggaagaactgctggcggaaatccgcgatctgttgaaagcacagcagaatgccgagaatgccgagtagtattgcctgcgggagtcaaaaacctcgccgcgagcggcggggttttgaccctcgcgggaataaagactgtccgatcagggaatcgtaagaaacagcattggaaaggaggctgccgatttgaatcagcataaaaccatttacctggcaggcggttgtttctggggcatggaagaatacatgtccagactggacggcgtctgcgaaacagaggtcggatacggaaacagcctggtggaatatcccacttacgaacaggtctgcaccggcactaccggcgccgcggagacggttaaactcatttaccggccggaggagacggaactttcgactctgctggaggcttatttcgcagtcatcgaccctaccatcctaaaccggcagggaaacgaccgcggaacccagtaccgcaccggaatctattacgaagatccggcggaccgggaacccatcttagccgccatttccagacagcagagaaagtataccgtcccggtcgtaaccgaggtgcttccgcttgacaatttctatcccgcggagcagtatcatcaggattatttaaagaagaatccgggcggttactgccatattgacgtcagaaaagcggatgtatttaacgaggaggaacggcttcgcagggatcacgattccgtcgaaggccctggaaaagagcgcagctatacggtcccctctccggaagaactgaaaagcaggctgacgccgcttcagtttgaggttacacagaatcaggcgacagagcatccctatcggaatgagtatttcaatcatttcgagcgcggactgtacgtggacatcgttacgggggaaccgctcttctcctcctctgataagtttgactccggatgcggctggcccagcttctcgaggcctctcaaatccctttcggtaaaggagctcaaagatcagagccatcacatggagcggacggaagtgcgaagccgggcgggagacagccaccttggccatgtcttcgacgacggccccatcgacaggggcggactgcggtactgtatcaacagcgcggctcttcgcttcattccgtatgaggagatggaaaaagagggctaccgggattatatggatctcgtctgaaaccatcagagatgcccctgagcggccaggtaacggaacctaaaatgattagaatcatgcatgcataaagaaaagaaccggggcaccagcccggcctccataatttggatggtcggaaacagatgctcccgattctttttcgttatgaactgtttcttacttctgtttttctaaactatgcttcttcccgcaaaacgattgctccgcagctcttcaggcaaagtgtaccgtcattctccagggtactgagtgtcccctccggagcactgtcatcattcgtcaggagaaccgtgtaattcttttccggaagcgtaagcatcttctcttcttttccgaaatttgcggcgataaatatccgatctccgctctcactttcccgatagaaagcaaagacatcctcgtccgcatcaaatgccgggacgaacctgccaaagatcagcgtctcccggtacgcttccgattttctaagggcaatcagcttcttatagaaatgaaggactgaatcctcgtcttttaactggtcctccacgttgatctccgtataattgggattcaccttcagccagggctttcccgtcgtaaaaccagcttccttctcatggctccactgcatcggtgtcctcgcgttgtcgcggctgtaacggatacaggcgtcaagtgcctcttcctctgtacagccagcctccagagccgtccggtactggtccttcgtgttgatatcgtcgtaatcttctatggaatccatggggcagtttctcataccgatctcctgtccctgatagagaaacggaaggccgcgaagaaggatattaacagccgccagcatcttgatgcctctgggattcaccgcatactccggcagatacgtggacgcgccgcggggctcatcgtgattttcgatgatattggccagaaagcccacgttctgaacctccagctgggattcgattacggtcttcttccattcggagaatttgaccggctttgcgtcgtaccagccgtgttcccctcccgtcagcagatgagcagagaaatcgaacatcgtcgaaaagtgaccattttctcccacaaattccttcagttcctcttccctcatattaaatacttccgcaaccgtaaatgcctgatacggatcgaaggccttctgccgcagctcctccagcagctcgccgaccccctcgacctcttccaccattttggtgcaggaagccagcccgtcgggaccgtctgccggaaaatccgggaaattcggatcctttttaatgttgatgatggcgtcgatccggaatccggccacccctttttccagccaccagcggatcatggcaaacagttcttccttcatcttcggattattccagtttaaatccggctgttcctttgcaaacaggtgcagatagtagaggtcggtgcccggaaccggctcccagacgcttcctccgaaataagaccggtaattgctgggagcaccgccgtccctgcccttttcaaagtagaaatagtccgcgtactcgccgtatggatcggcaagcgccttctgaaaccattcatgctggtcggagcagtggttgatcaccaggtccataacgatctcgatccccctcttcttcgcctcggccagaagctcatcaaactcctccatggtgccgaactccggggcaatcttatagtaatcggaaatatcgtacccctggtccacaaagggagactggtagatcggcgatatccatacaatatcaatccccagttccttcaaataatcgagtttctctataattcctctcaaatcaccgatcccatccccattgccgtcgttaaagctcttgggataaatctgataggctattttctcatgccaccattttctttccatggtcttcctcctgttgtctcaaatgtattgtcattataatacggagtgcctgacatttcttgcagtatacttcccaattctaacacaattctgctgtattctctgtctcgcccctgctaaaccgtactctggaccggagaaagtacaaaaaataccgtattttgctaaaaaacgtttgtatatttatgatttttcttttataatagataggcagtctttttcttaacaggggaaaatgcgaaagataatgataaggagaaatgatgactatggaagaacgtttgatagggacaatttcaagaggcgtacgtgcaccgattattcgcgaaggagatgaccttgcaaaaatcgttgtagattccgttatagatgctgccgccagcagccgctacggctttgagattcaggataaagatatcgttgccgttacggaggccgtcgttgcaagagcacagggcaattacgccagcatcgacaacatcgcagcggatgtaaaggagaaattcggtgatgaggcagtcggagttattttcccgattttaagccgtaaccgtttcgccatctgcttaaagggaattgcccgcggcgtgaaaaaggtcgtgcttatgctctcctatccttccgatgaagtcggcaaccacttaatcgacgaggatgagctggatgcaaagggcgtgaatccatgggctgatgtgctgagcgaagagaaatacagagagctgttcggctataaaaagcacaccttcaccggtgttgactatatcgagtactacaaggacgtgatcaaagagcagggcgcagaggtcgaggtcgttctggccaatgactgccgcaccatcttaaagtatacggacaatgtgatctgctgtgacatccacaccagagcgagaagcaaacgccgccttctggctgcaggagcgaaaaaggtctgctgtctcgatgacatcatgaccacgtccatcgacggaagcggttacaatgagaactacggactcctcggttccaacaaggcaacggaagagactgtcaagctgttcccgcgcgactgccagccattcgttgacagagttcatcagatgatgatggagcgcaccggcaagcacgtggaagtgatgatctacggcgacggcgcattcaaggatccggtcggtaagatctgggaacttgctgacccggtcgtttcaccggcttacacggaaggtctggaaggacagcccaacgagctgaagttaaaatacctggcggataacgatttcgccgatttaagcggtgaggagttaaagaaggccatctctgagagaatccgtacaaaggatgacaatctggtgggcgacatggcttcccagggtaccaccccaagacgtttaacggatttaatcggttccttatgtgacttaacctccggttccggagataagggaacaccgatcatcttcattcagggatattttgataattacacgaagtaaggaagcttgtccgtccggctccatgctctcgggaataaaaaggaaccggcgtccggccaatgtatattggcgggcgccggttcctttttgctgccggcttatctgttatttaagatccttgcttatttactgcaattatacatgaaacagtaaattccgggaagtctgaacgctcatatattttttaccaccactaccgctatggccgatccaaagacaagcacgaaccagattgccgtcagccacaatggccattggatttccagcattcggttgaatgggatcacgaagaggctggcgagacaaatctgattcaaccccacaatctgtttttcataccgcaggcgtctgttttcggcgcgcttcaccagccgttctccccgcattctcttttctgtctcctcctccccatgtccggctgcggcggcctgtaatacagaggccgccagagccagcaccgtgacggccagtgtccagacggtcataactgtctcggaaaccggtattctaaggactgagttcaccgggaaaaataccagcgacgcaattccgcacatggcaaagaaccagacaatccgtctcagctttatcacaggttctgttctgtctttcttcagccgttccgcccctctccgctctaaaaccttcatctgcagatcaaatagtcccgtatcgagcgtctgaaaatcccagtccctcttctttaattccaggcagaccagtttcatccggttcaatgcggcctcctcctctttcagctgatactcccgctccttaaggagctgtgcaagagaccgcttcccctgctgaaactgccggatatcggaaaccgtgactcccagcatccggagatacttgattttctccagcacctccctgtcttcctctgtatattcccggtaattattctcaccgcgtgccggtgacaaaagcccttctttttcgtaaaagcggatgttcgccttcgtaactcccacctgccgctccatatccttaattttcattgtctttcgcctccttctttccctcattataagggttcaacaaggtttaatgtcaatagaaaaaataaaattatgcagctcagaggtccagactgaaaagcgaaaaattgtaccgttagaatttaccaccacttaatcagatccgtcacttcatttctcaaatccacaaaatccttcgccgcaatatcccgcggcctcggcagatcatttcgaatctctttcttaatactggtaggcttattggtaagcaccagaatccgctcccctaaataaaccgcctcttcaatattatgggtaataaagataaccgttgtcccgttcctcttccagagatttaggagttcgtcctccagcttgaatctcagttcgatatccagctgtccgtacggctcatccatcagcagcagctccggctccgtggcaaacgccctggcgattaccaccctctgcagcatgctggcagagagctgatccggatagtacttccggtattttgtaaggcctaccacctctaaatactcgtttacctttcggtccgtggtttcctgatccgtgtgcttaatctccagaccaaaccgcacattctcctccaccgtcagccatggcatggtggaatactcctgaaaaatgtatgcgacgctgtgtttattcaaatccacaggctcattgttaatcaggatctctccgcttgttggctggtaaagcttcgtcaggctgtttaaaaaggtcgtcttgccgcagccggtagggccgacaatacacaggaactcccctttcttcacatcgaaagagatctgatccagcacgaggaggtcatcgaacttcttcgtcaaattcattacctttacttttgtttcccttttttcttccatgagcgcctcctttacagcgatttatccatattttccgtaatctcctggcggaggcggagaaattcagggtccacgtagtttctcggatgcggcatatcgatgatgtattccttcttaatggtggatggacagtttgtcatcagaataatccggtctgccagaaataaggcttcctcgatgttatttgtgacaaagataaccgtgcgtttttccttctgccagatcctctgcagctcttcttccatcatataacgggtctgagcgtcgagatggccgaagggctcatccatgagcatcaggtcgggattgttgctgtaggccctggcgattccgacacgctgacgcatgcctccggacagttgggagggatagctcttttcaaatccctttaatccaaccaggtcgatataatgatccgccgtcttcttccgttcatccttgcttaagccccgcaccctgggtccaaactctacatttcccatgacggtgagccacggaaagagtgccgtcttctggtacacaacgccgcgttccggcgccggttttcccacttttttgccgtgatcgatgacctcaccggaggtaggggtgtcgaggcctgccaggatattgagcagcgtagtcttcccgcactgtcccggtccgaaaagcaccaggaattcattttcacggacagaaaagtcaacatccttcagcacgtggttctttccggagccgtcgtagctgtcaaactccctggaaacgtggccgcaccgaagcacctcatttacagtccctgctgctgattccatatgcacaacctcccttccagttttgccatggccgttgccagaacgtatccaacaatgccgatagccagcattcctaccataatctgaacggtgtttccgtttgtcattcccatgacgatgagccagccaacgccctcatccgaacgcaccatttccgcaccgacgacggccgaccagcctgccgtgatggcgatctgaagccctgcgaaaatgtaaggaatcgacgagggcagaactacccggaagaacacctggcgttccgaggcccccagcattctggcggctcctaaaaggacagagtccacatttttcgttccgtcatacgtattgaccgtaatgaagcagaagcagcccaggaaaatgatgaaaaacttactctgatcgcccagtccgaaccacaggatggacatgggaatccatgccagaggcggaatggggcggataaattcaaagattggtttgatgatggcttccacagttttcgaataccccatggacacgcctaacgcaatgccggcaattgtcgcaaagaagaacgcaacacctacgcggtagagacttacgccgatatgcaccagcatggtatgccttccgatcggtaccgtaaagctctcgaagaatttccacagaatttccgatgcaggagggagaaacatctttgcattggtaaaccgggccacggcttcccatacgataagcagggaggcaaatgccacaaccgtcatgacggcggccatatttttctttaaaaaacggctggatgcgctttccattctattttcctcccttgacgaatttattctgcagcttttccaggataaaggaaagcagataaccgatcacaccgatggtgatcattcccacgatgatgacatcggggcgtcccagcatccttgccacctgaatcatgtagcctaaccctctcgtcgctgctaagagctcagctgccaccagagctacccaggaagaaccgagtgccagccttaagccggtaaaaatcatgggaagagccgtcgggattgcaaccttaaacagcatctgcctgttggatgcaccgaacgtcctggctacccataaatgaacctggctcgttctcttgattccggcgtaggagttaatggttgcgctgataaacgccgcaaaaaagataattcctacctttgaccagtaaccgattcccagccagagaatcatcagcggaatccacgcaagcgccggaatcggccggattacatcgaacagcggtttggcaaacatctcgaatttacggctccaggccatggcaattcccagcggcactccgatcaacactcccaccacgtatcctccaagagcaatcttcatactggccgcgatatgctggagaagggtcgctccatccggattgacccctcctgtcagcttgtagacaaacgtgtccagtacctttgccgggcttggaagcatcatgggagaaatcagatgcagaatatcggttgccatttcccagataaacaggacggtgataaccgagcacaccgacagaatccggtacttatactttgcagcaatttctttcatctgcgttccctcactttctctaatttacccctttgacaaactccggatcgatgttgctgtcaaacttgtccatcagctccggttccagctgtcctaagcctatgtagaattctcccagttcccttgcgaaattgcctaaagtacggtctttccagtcagccgcggtgataaactgcacacgtcccaagtcgctgacacagctctccctgctggcctctgctcccgcatcctttaagaaatccaccatcagatcagccgccatgtcgggatcttcatttaacgccttgcaggcttccacaacacagtccatatatttctgaaccagctccgattttccttccactgcttttcgattgcctacaaccatatccacgtagcgggttcctaaatcggcgagatttcctacctgcaccatgccgtcatctacggcttcaaagaacgtcggtacatttaaggctaccgcgtcacactggtttgctaaaagtgcctggtaggcctgtgccgtatccatatttacgatattcacatcggtgatacccagtcccagtttttccagccattttaatgtggtaaaatgctgagccgtgccgatcggaagaagaatcgtcattcccttcaccgtctccgggcttccgaggacattgggatacgatggattgtagcctttttcctgcgctgccggtgaattcggttttacgaagactcccaggccgtctgtagactccaggacttccccgataatcatcatgtcatagtttgccacaccggtgacggccgcggcgcccatggagcccacatcccacaagtcggcggccagcgcctcattcatgggagcacctgttgcaaacataatggtatccattttaaatccggccttctcatccagcttattcttcctgatatactctgtcggaaggcttgtgataaacggcatcattgccacacgaagcaccggcagatcccctgacgcctccgcctttgcatcctttcctccagcagtgctgctctggctgctgcccgcgcttccacaggctgtcagtgcaagtgcaaggccgagggccatagttgaacgtaatacttttttccattgtctcatatcgattcctcctggtatttcacgagcttcatactttggctcattataataggtccttactgtcaattggaaaacacatgaacactcgacttgccgcaaccaactcataagttatccgtgttttcctcttatgagcccattatagcccggctgccaggggctgatttttctattattttacttttcttttgcatttcagatcaaacgagcatacggaccggaaatcactttttaaattcttacttttgtttctatattttgacttttttacgcgaggcacagaaaaacgggtaaagagagtgacattctttacccgtttttccgcgaatggatattactttttatttatttcacaaccagattcacgatcttattaggaacgtaaatctcttttactatcgtctttccttccagcagcggcacgatcttctcgtccttcaccgcaatggcaaatgcctcttccttatcacagtttgcaggcagtgccaccacgcttctgagctttccgttcacctgcacgccgacttccacggttgaatccatggtctttgcctcgtcgtataccggccatttcgccatggagaggaatcccgttccgcccaggctttcccagatctcctcgcacacatgcggagcgatcgggcataacagcttgatatagatgatgagctcgtccttcgtgatctgccccttcgcataaatgtcgttcagcaggcccatgagtgcagctatcgctgtgttgaacttcatttcctccaggtcgttcgacaccttcctgatcgtcttgtggaacgcggtctccagttccggtgtcgcgccctctccgctggcaatctcacacagtccggcaacacgctccaggaaacgcttacagccctttacggagctgtcactccacggtgtggccgcgccgtaatcgcccatgaacaggacatacgtacgcagaacgtccgcaccgaactcttccacaacgtccagcggatccacgacgttgcccttggatttgctcatcttgtccccatccggtccgaggatcagaccctgagcggtacgcttcgcataaggctcttccgtgttcaccactcccatatcgtacaggaaatggtgccagaaacgggaatagatcatatggcgtgttacgtgctccatgcctccgttgtaccagtcaacaggcatccagtattttaacttctcaggatcagccagcgcttcctgattatgagggtcgatatatcttaagaagtaccaggaagatccggcccactgaggcatggtatccgtctcgcgcttcgcggctcccttacacttcgggcaggtgcagtttacgaaggattcgattccggcaagcggcgactctccctcctggcccggctcgaaattatccaccttcggcaggcggagcggcagctcctcatagggaaccggaacgacgccgcagtcagggcagtgaacgatcggaatcggctctccccagtatctctgacggttaaatgcccagtccttcatcttatactggacaccggcttcaccgacacccagcttctccagctccttcaccatgcgggcgatggagtcctttttattcgtcaggccatttaagaaatcggaattgatcatcctgccgtcgccggcgtacgcggcctcggtaatatcgccgccctcgattacctgcacgatgtcgatgccaaacttcctggcaaattcatagtcacggtcgtcgtgggctggtacagccataatcgcgccggtgccgtatcccatcataacatagtccgcaatatagatcggaatcttcttgccggtcagcggatgaaccgcgtttagtccatcgatacagactcccgtcttctcttttaccagctgggtacgctcgaactccgtcttcttcgcacactcttctctgtatgccttaatcgcatccatattggcgatctcatccgcgtacttgtcgatcatcggatgctccggcgcaatgaccatgaaggtgacgccaaacagcgtgtccggacgtgtcgtatagatacggaaggactcgtccttgtctgcaaggctgaaatccacgaatgcgccttccgacttgccgatccagttcacctgctgctgcttgatattcggcaggtaatccacggtatccaggccatttaagagcttgtccgcgtattccgtgattcttaagaaccacaccgatttggacttctgaacgatgtcgctgtggcagatatcgcactttccgccctggctgtcctcgttggataaaacgaccttacaggaaggacagtagttgactagagccgtgtcacggaacacgaggcccttttcaaacatcttcaagaaaatccactgggtccatttataataatcttcatccgtcgtgtcgacaactctcgaccagtcgaaggagaatcccacttttttcagctgattggaaaatctggcaatgttgtcatctgtaatctttctcgggtgcacgcctgtcttgatcgcatagttctctgtcgggagtccaaaggcgtcaaatccaattgggaataagacgttatatccctccatcctgcgctttctcgaaatgacttccaggcttgagtacgccttgatgtggccgacgtgcataccggctccgctcgggtacggaaattctaccagaccgtaaaatttcggtctctcgtcgttgtccacagcctgaaagataccggcctcgtcccattttttctgccatttgggttctatctttttaaaatcgtgcttcataatctgcctccatttttttgctgatacgaccattatatagattccttccataaaatgcaaggttttacttttttaagccgtatctcataaaaatttcctccgggcagccgttttccttcatccgttccgccatgagcgctgccatataccgctctgcctcttcatcgtgtatcggatgctcctggccgggatcattctccagatcaaacagcatggtatcgtacttcgcctggccaacttccttctcatatggaattcttaagaccggaagccccttggtaaaggacaggccttctgacagcgtcatcttctccagttccccgttttcgataaacgctctgcggccgccatggcgggtcggcatcagcgtgtactgataaatcccggtatctgtatccacaggactcctcatatagacatacctcccgtcggtacagttgatctgccctccgaaaatgccgtacagcgccgcttttctcaccaccttcccgccgtctgcaagcaccggctggagcggaactccctccatgtcctccggcagccggagcccgaactgagcgagaatcgtcgccggcagatcgatggtctgaaccaggctgtccgcgtgaattcccctggcccccgtcaccggatcccagacaaacagcggaattctggccacttcattgtagaaagggcagtggcatttggcccactgaccgtgctcagccagcagaaaaccgtgatctgtgtttacaatgaccatggtgtccttccacatgccgtactcgtccagcaggtccagcacctctcccagcttctcgtcacacatggtcagcagcgccgcgtattccgccctcaggtgaagaatctcttccggcgtgtcccgctcatccaccttccggtaatccggccagtcatagacgccgccgttatagggatccggaaacagcttcttaaacttatcctgggagaaaaacggctcatgaggatcgaaggtctcaatctgtaaataccactgatccgccccgtgatttgtccggataaaactgcatccggcttcaaacgtcaggctctgcggctgtttttcctcggtctccatataagaacggttgacaaaatcctgtggaacccaattgtgttcccagttatctgccaccccgtcacagcggtttctgtatccttccggaatctgatccggggaaacaacgcccttccaggcatccccctcctgcccccgaaagccttcccacgtccggtatctcgtatggtaggtggcacccccatcctcaaaatagtggtaatggtccgtcaccatatgggaatgaattccgctgtgatttaaaagctccggcatggaatcgtcgaatggttccagcggcccccagctccggtgcagaaaattataccgccccgtatgaagctccctcctggccggcatacagggaagactccccgcgtagcagttgttaaatgtgacggaatgctccgccagcctgttaaagttgggcgtggccgccaggttccctccataaggattcagcatattccggttcaatgaatcaaacattaccatgattacccgcatctttttcttctcctctcctgtattcatagggattgaccccgtagcgtttcttaaaagtcgtcgagaaataactgacattcggatatcccaccgattccgcgatcttctggacgcgctccggtgtatgggacagcagataagccgccttctgaagccttgtctcagagagaaatgtgctgtaggtacagcctgtctcctccttaaaaattctcgacaaatactccgtatttaaatggacctccctggacacgctctccaggctgatcggttcgctgtaatggtgtctcacgtagtccacggctgcagccaccccctttgacagatttctctcgtccatctcctggtaggccagcgcgttccggataaattccgtcacctttttgcagctttccgcgtagctgacagactcgcttaccgcccgcttctcctccagaagcatgtggtgcatcagctttgcatcctcaccggcaaagcgcatataggccatctccatggcatcacagcagaaagcggcaaacatacagaccggaaatacgccctcctgcttcgcatggtccagcaccgcctctatggtctggtagaattcctggccggacacctcgtagagctcgcgccgcgtcttccggtatccgctctcccatcgcttcacgaggctgcgaatctcgtttcccgccatctccgctggccagaccttctctttttccatataataaccgcggcttaagctgcaggctgcctcgataatcgcgtccgccacatgggcgagactgcccgtcaccgtgctgattcccgccatacaacggtttttctgtacgatagctgtcccatactcatgcagcagctggattttctgcagttccgtccgttcccgctccagattccccacaatcacgtacgtaagcctgtcgtattcgaatcccaccacatggtgaacctccggattctccggaaggatgaattcctccagcacctcttttttccacacggccacggcaaacagcccctcatcacgccaccggatattgcattccttaagtttctttacatcctcttcccccagagtccttccctcccgcagtatatcgccgataatggaatgctggcggccggtgctctccgtctctgccccgcctctggatacctcgtgcttagtcacccgtttttttaaccgttccagaacctccttaaacgactggttgttcatctccgtcttaagcaggtagtcgtctccgccctgccgtatggcctccctggccagatcgaattcggcaaaggcggtcaaaaggaccacaaccgtctccggcgagatctccttaatccgctttaaaagctcaagacctcccataaccggcatcttgatatccgtaaaaaccacgtccggttcattttcctgaaacagggcgagtgcctgctctccgttatgggcgcagccggtcagctggcactccgggttctgcccgatacagaactgaagccactcgcatatcattctctcgtcatctactatcagtattttcataatttaccccttgcatctctttaagcaccacgggaaacctcatggtaaccgaggtgccgattcccggctcgctttccaccgtaagcccgtactcttctccaaaattaatcttgatccggtttaacacattgagaattccgatggatcttccggactggtattcccgttcaccaaactgcgccgtcatccgggcaagctccttctcgtcaagccccacgccgtcatcggagacggtgatcagcagggctccctccgacacaacggattccacgataataagccccgcctccgcctttgcctcgattccatggaagatggcattctctacaatcggctgtataatcagcgcaggaacgaggcaccgctccgtctccgcccccatctcgcactcataatggaccttgtccccataccggatctgctgcagcgccaggtatttttccgtgctctcaaactcctccttcagggtgatgaaatccgtgtccacagacagcgtcttcttcagaagatcggtaaaggccgccatcatcagaactgcctggtcattctttttcagttcgatcatgcactggattgaaaacagcgtattatagaggaaatgcggattgatctgcgcccttaagaaatccatctccgacttgcgcttctgcatctcattgtcccgaatgtcctccaaaagcttcttaatctcagccgccatctcgttaaagctgtccttcagctgattgacctcctcgtatccccggatgtcgctgatcacgtcaaaatctccctgcttcacccggtccatcaggcggcagagcttcaggatcggcttcgatatccgttccgacatataacaggccgctcccgttccgaccaggagacagccgcttacaatcgccaggagaagcaccagcgcctggtttaaaggctgcagtataacggcgcacggcatctcttccacaatcgtccatccggtctggggatcatagtagttggacagcagatagtcctgtcccagctttttgataatgtggtactcattctccccgtaaagccgtctgaaattatcaactccgataaagttctttccaagcagggatttctcccggctggagacaatgttgcccttcttatcgaaaatatagaggttgctccggtcttcggccgttccgtataagtcttccagatatttttcatccacattgacgagaatcgttcccgtttccccgccttccgttccggccacccggcgaaaggctgcgaatacgtaccgctcttccctgctcgataaatcaaacttctcccggaagctgctgataaacacgatatcattttccgcgtcgtagctccgcttataccagagctggctctccagcccgtcaaaatcgtagtggtcccgccctctggaggcgtaacggaatccattatctcccaggatcaccacgtcgtaggccacccccacatcgtgaaataccctgtcgtagttctccttcaccccgtccaagtagcgtccggcctgccccatctcttcctccgagaggccgttctcatttaagcatctctgcacctcttcatcataccggtatagattggatatggtgatggtgctgttttttatggtgttggaacgctctgaaatctgttttaatacatccagacggctttggccgatctggtccatcatcagctgttttactcccagaaacagaaagctgataatcaggatggaaaggacggcaaaggtaacgccgtatcctaaatacaactgagtcttcagtttcccggacgcctgtttaaacttctcccaatacttttttatctcgctcacccgctcattcttttaacttttctttgatgtaatcgtcgcagctgtgggatacctcccccttgctccagagcccggcaaggccgatctggccggagccgaacacgggctccttagccccgtcgatttccggattgacgtatttgataaaccactgttccagctcgtaattcatcgatcttccgatctcctcatccttctcgttccccgccagaagcaggtttctccgctctcccggatcctcctgcagatcgtacagctcattggggccgtaaggataccgttttataaacttatatctgctcccgcggatcatacggttgggaccgtactcatccatcaccacaatggattctccctgatgaaattcctgccccagcagtgccggaaggaagcttttccccggaagcttctccccacgatccgttccctcgataccaacataatcgagcagtgtcggcataaagtcatatgcagacagaagcgaggaattcaccgtccccggctcgatcccccctggctggctcataatcatcggaaccttaacggaagattcgtacatattgattgggaaggtaccgtttccctttccccagaagccgtgatggccgcagctgaacccattatcgctgccaaagatcaccagggtctcttcccggatccccagttcatcaagctgctccaggattcgtccaatattatagtccatggcggtagcagctgcataatatccgatctgattcgcccgcaagtcctgtaagacttccttcgtcagataaatactgtcgggatgctctttctccatgggacaggacaaaaaccggcaattctcatataaatcggtgtattctttcggatggttgttaagccagggcgcgtgaggcgccgtatagcccacatgaagatagaaaggctgctttcccgcatgctctttcaaaaaagaaatggcgtcatccgtgatgacatccgtgacataaccaggttcatagaccagacggccctctctgtaaaaaggagcaccataataagggcctccgccagatttgtgcgcaaaccagtgtgtaaaactcttttgaggtacagaactcttccccaggtgccatttgccggacaggccgcacacgtatccttcctgtgccaggatgtcggtataggcagtctgacctgcaagatattctatatcctcctgttttttattatcgtcgcgaatccagtcgtgaacgccgtgctgagacggaattctccccgtcagaagtgacgcccgcgccggagagcataccggcgatgcgcagaaaaagttctcgaaacgcatgccttccgctgccagcttatccaggttcggtgtgataatctcctcattgccggagcagcccatggcccatgctccctgatcgtcagataatataaaaacaatatttggtttttttgtactcatttttgttctccttactattacttgtggtaatagctgcggcaagtcgaacatttatctttagtatagcgaattgttttttaaatgtaaagcaaaacaggagcagaaaaatcgctgtcagtcatttttctgctcccattcctgttattctcttatttaaaatacttcacaccggattcgaatatcttcaaatcctgctccccataaatattcatggcaactgcctcgccccgtctctcggagtgagccatcttgcccaaaattctgccatccgggcttgtgatgccctcgatcgccatataggaaccgttcgggttccagaactcgtccatcgtcggattcccgttctcgtccacgtactgcgtcgctacctggccgttctcgaacagctttttaatccaatcatcattggccacaaaacggccctcgccgtgagatgccggattgcagtatacgccgccaagctcggctccctgtaaccacggagacttgttcgtcactactttcgtataaaccatcttggaaatgtggcgtccgatggtgttcatagccagagtcggagaatcatttctctgcgccgtgatggttccttccggcaccagccccagcttgatcagcgcctggaagccgttgcagatgcccagcatcaggccgtcgcgctcatttaacagcttttcgatctcttccctgatcaccgcgttgcggaatacggttgcgaagaatttcgcggacccctccggctcgtcgccagcggagaagccgcccgggaacatgacgatctgggcttttgcgatctcttctctgtacgcctccacggactctctgatgtcatcggcactcatattcttaaatacctttgtcaccacatttgcaccggcccgctcaaatgcctttcggctgtcgtactcgcagttggtacccgggaataccggaataaatacgttcggttttgcaaccttattcctgcagacatagatgtcctttgtatcgtagagcgcttccgtcacaggcgtatctgcaacacccgatctggtcgggaacacattttccagagtctctgtccatgcgttcagcgcctcgtccatggtgatggccgtgctgccgtattccaggactccgcggtccgtcacttcgccgattactgtgtaggaaatagacagctcacccactttaccgtccggaacctcgcagacgatggagccccagtccggagcgaagaaatctctcgggtccacattgtgctcgatcttaacgcccagcttgttgccgaacgccatctttgccacggattcagccaaaccatggccttccaccgcatacgcggaaatgactctgcccgcagtaatctcatgataaagcttctcatacccatccatgagctgctcataaaccggcaaatcatactggtctttctctatatggaacacaacaatcttactgcctgccttcttaaactccggagtgatgatgtgcttctgatcggcaatatccacggcaaaggataccagtgtcggcggaacgtcaatctcattgaaggttccggacatgctgtcctttccaccgatggatggaagtccgaagcccagctgagcctcgtatgctccaagcagagcggagaacggctggctccagcgggaggcctcctccgtcatccggcggaagtactcctggaaggtaaaacggattttcttatagtcaccgcctgcggccacgatcttggctacagaggaaacaaccgcataaacagcgccgtgatatgggctccagctggataaatacggatcaaagccgtagctcatcatcgtcaccgtatctgtctttccggcaagtaccggaagcttcgccaccatggactgcgtctctgtcagttggtatttaccgccgtaaggcatgtacacgctgcccgcgccgatggaaccgtcgaacatctcaaccagccccttctgggagcagacatttaagtcggaaagcaccttcatccactcaccccggacgtcagaaatctccttcctgtcaaacgctctgccttcctttccttccgccaaaccggagttggaagcgcttaccctgttcgggacctccacaacgacggaagcctcctgatgggcaccgttcgtatccaggaacgcgcggctgatatccacgatatttctgcctctccagttcatcaccagacgcggctccccggtcaccacggcaacctcgatagcctctaagttctcctccgcagcgtaggctaaaaactgttttacgtccttcggatcgatgacgacagccatacgctcctggctctcggagatggcgatctctgttccatccagaccggcatacttcttcggaaccttgtctaaatcaatctgtaagccgtcagccagctcgccgatggcaacggatactccgcctgcgccgaaatcgttgcatttcttaatgatgctgctgacttccgcacggcggaacagtctctgaatctttcgctcggtaggcgcatttcccttctggacctcggcaccgcaggtctcgatggacgcctccgtatgtaccttggaggaaccggtagcgccgccgcagccgtcacgtccggtacgtccgcccagcaaaatgatgatatcacccggatcagaggtctcgcggattacatttttacgtggagctgcgcccatgacggcgccgatctccatgcgctttgccacgtagttgggatggtaaatttcttttacatatccggtggcaagaccgatctggttgccgtaggagctgtatccgctggccgcgccggtcacgatctttctctgaggaagcttgccctttaacgtctcatttaacggttttgtcggatcggcagcccctgtcacacgcatagcctggtatacatacgtacgtccggacagcggatcacggatagctccgccaagacaggtggcagcgccgccgaacggctcgatctccgtcggatggttgtgtgtctcattcttgaaattgacgagccactcctcctcttttccatcgatttccacaggcaccacgatgctgcaggcgttgatctcgtcggatacttccagatcatccagtttgccctccatgcgcagcttcttcatggccatcagcgccagatccatcagacagacgaacttgccgctctttccctttaacaccacctcacggtcagctaagtacttctggtacgtcgtttcgatcggaacccggtaatcgccctctgtaaatgtcacatccttcagttctgtctggaatgtggtatggcggcagtgatcggaccagtacgtatccaggacgcggatctccgtcatggacgggtctctcttctcctcgtccctgaaatagttctgaatatgcttaaaatccttaaaggtcatagcaaggttcagggaatcgtacaactcctttaacgcgccttcctgggagctctggaacccgtcgaatatgataacgtcggccggtgtctcaaacacggttaaaagcgtctccggctttgtctcatccgtttctctggaatccaccggattgatgcagaaggacttgatatccgcaccttccgcctctgtcacggttccggaaatcacataggtcgtggccgatttgatcaccggctcctcgtcttccttcaaaagcttcacacactgctccgcagaatcggccctctgatcgaactggcccggcaggtactccactgcaaacaccacgtcattttcatttctcggaaatgtctcctcgtagacctcgtccaccggcggctcggaaaaaattgtctcaagcgctgtcttataagtctcctcggataaattctcgatgtcatagcgaatcagaacacgtacatccgtcacggtttctatcccaagatagctggcaatctcctccttaagctcatgggcctttacggcataggccggtttcttctctacatacactcttcttacgctcataatttcctccttggaaaatatcattaagttccaatctttatgtttcatcgggacgcactgcaccctttacttctcgttgatataataataccacaagatatatcaattagaaaaattaatatatcttatggtattaattattgtatcttatatttatactgcctgtagaaggaaagaaatcagccaggtgatcgcccactgcagcaccaggctcgctgcccacagaatgaccatcccttttatactggttcctccggctttctgaagagaatccatgagtgcatccttctggacggcacgccttccgcggcatccctgttcatcgagaatggcgtttatatggcggctgtagagccagtcgcccagcagcccgaacacgatcatggataagacaaacagaccggccgccgcactcatgaacaccagcgcgttgtccgccgtcagcatcgtgttctccaggacggacaacaccatcgtataaatcacattgaagcccataatagccgccgctgccttccacattttgcggtaggcaaaccataacgcggtaaacagcgccgcacaccagttaaagctgcagcctttctcatgaacccgctcgaactttctcagataaacggcgctcttttttccgacacacgtcatgatatctgagacgagatactcaccgatccttacgtcggtcatgcgttccccattcacttctgtcttcacctctccttacgtccgcctcatcactcaaacggcattttccataatctgttttattatagcatgctttgtggaaaatggtttactttttttatatttgatgttgcccggcaaccatagtataatatagaaacaggaaggtctgaaaatcagcaaactgaaaataaaatcaccaaacatcagaaaggcataaccgctcatgactgctcagaataaaatgctctcccaaaacaccgcagaaaacatccgctcaatgatcacaatcgaaaaacgttttgcccccggggaccggctccccaacgaacaggatctggcggacgagcttcatgtcagcaggaccaccctgcgggaagccgtaaagattctggccgcgtaccgcgttctggagatccgccgggggatcggcacctttgtcacggaggaagcattaaatgaaacacaggattttgaacagctggccgatgtgaaagccaatgcaaaggacttgtatgagatgcggctcatcttcgagccggaagccgccgcccttgccgccctgcgcggaactgaggcggagatcagacggatcctggagatcggggaacatatcgaacaggagattctctcaaaccgggaccggactgacgatgaacacgcattccaccgcgcaattgcccaggccacacacaatgaatttatgaataagctgatgcctgtcctctatcaggccatctcaaagggcgtcgtcctgtccgaaagaaatgagcaggtaaaaaaccacaccatggaggaccaccgcatgatcatggaatttctggaacagagaaatccggaaggcgccagaaatgcaatgaaaatccacatacttcacgcaataaaagaactgaatatagagtaaaaataaaaatcagatatccgcgcatctatccgccggacatctgattttttattttatctttcagtcataccatgtctcattgacatcgtatctctttcggtctataatcacattaaaccctgcatttacgcaggagacccgcagctatatctcatatcaatcactcaaaacaaaaggaggaaaaccatgatggaactcatcgacttaaccacctgggaccgggcccttcactaccagattttccgaaacagcgcccagccgcaatactgtgtcagctttgaactggatatcaccaattttctcaccgcaatccgggaaaaggggtattcctttaccttttccttcgtctatgctgttgcggactgtgccaaccgaatcaaagaattccgctgccgctttgtggacggccagcccgttgtgtttgaccggatccacacatccttcacgtatctgaatccggatacggagctttttaaggttgtaaatgtcgggatgaaagataccctggaggaatacgtcgccctggcgaagcgcatggagcagaatcagaaggattatttcaccggccccatggggaatgatatcttccagttctccgcatttccatgggtatcctttacccacatttcccacaccgattccggcagcagggacaatgccacaccgctgttcgactggggaaggtatttcgaacgggacggaaggacactgcttcctttctcggtacaggtgcaccactcctttgtggatggcgttcacatcggaaagctggcaaagcttctgcaggactacctggactgtttttgttccacgtctgtgtaatacagatgccttggcagcccatctaccatgatcggcgtcagctccgcctgaatgagcggcttgatatagcttacgaactcctcggtcacgtagtcgcccgcctcattgatccactccctcggcacctttttctccacatttgccaccttatggacgtcgtagatatcggtcacacagatatacgggtcgtccgagacgcgctttaagataatcatcttgcctgtctccccttcgaacgccgctttgacggctgcgccgcccacctggaatgcctcggtaatatcaacccgtgacacgatatgggaggcgcagcgctggagggagttaaactcgatggccctcgtcttgcatccgacttcccgtgaaatcttctcggcaagataacgtgcggtcccggtcagctgcctgtggccaaaggcatccacgtaatcgatggtgtcggtcagctcacagacgtagcgtccatccgccatcttcacaccctctgaaatcgcaaccaccacggattttttccgcttgtgcagctcttccacctttttcatgaagttctccacatcaaagggaatctcagggagaaagatcatatccggcccctcgcagtcctcacacttggcaagggcggccgcgcccgtgagccagccggcgttgcggcccatgatttccaaaagcgttacgttctgctggtcatacaccaggccgtcacggattacctccttcgtgatggaacctatgtattttgcggcgctgccatatcccggtgtatgatccgtcgcggctaaatcattgtcaatggtcttcggcacgcccataaaccggatcctgctgccgtttaagatggagtaatcggagagtttttttatcgtatccatggagtcattgccgccgatatagaagaagtattccacctccagtttatccagaatggaaaagatctttttatagatctcctggtcttcacagatctccggcagtttgtaacggcaggagcctaaataggcagagggagttctctttaacagttcaatatccagatcatttttgatgtgttccgacagatccacgtaccgttcttccagcagtccctgaataccgtgcagcatcccgaaaaccttttttgctcccctgtcctttgctgtcttatagacacctgcaagactggaattaatgaccgccgtgggtccgcctgactggccgacaattacatttcctcttacctctttcatctccgcaatcctccatgaccatgattattttttgtttttgtaagtacttacaattcctacgctcctatcataatatagagaaattgtaaaagtcaactgtagatattttattcacaaattttcattgttttacaatgaatacaagccattttttggtctcatgcaaagaaaaaagcagggcgttttacgcgctctgctcttccactgcggtcacattcgactccagcatttctttcaattcttccattccgattccctgttctgtgagcaggccgcggattgttttaaactcctccagttcgatctgttcgtttaatgctttttccttttcttttaaggtaacgaggcagttctcatactgtttgatgctctctcttacctcatttaactgatcctgtaatttttccaccggtgattttcttacgcctctcgccatattgaaaacgctccttttctttcctgttataggttgtatcattcttttttagtatatgtaaaaaagtgggaacttattccataaataacaaatatccattacttctccgttccaatatgatataatgaaaaaacaaacgaaaaaggagatctttatggaaaaaatacgatccataagaactgcgctggcgttcagtcttgtttttctgttagccggatgttccgggaaacaggacggcgccatgacaattcagaaggctgagctgacggaaaaggaacagcagactgtcgccttgattgagaccggacgcagtgtaaaattatatgattataaaacggaacccgggatttcttctcttcttttttccgtcgaaacgctgaacgaacaggggcagtgggaaaccgtcgcttcctctgttttcagccagtccggccaggaagatgaccgcgtcgccattctgttttccgatgactccattaccttttcctgcggggagggccggtacgaagtcatgctcggttccagccattataaaaatactgcggattcctggctgacagagacttcccccatccggacagatgaaaaaatccccctcggtatcgtggcatacaccgactccgattccgtcatctttccaaatacagacgactatgaggaaccggaaaagctgtctggcagacagtataaagaagtcaaagccgtcaccctccagttctccggtgagacactccccggaagcgaaaaagaaaggaacacaccatgaatatgaaaaaaacagcatttaaaaccctcgcgctgatctttaccgtgctgacccttttaggctctctctacgtcctgctgcagagaggccaggtaagccccggatatgcggtgattcccatgctgtttgcaatactctttatccaattgtctcattccgtgccccggtaaacgtacagagtgccgctacctcttacagagatgcgcggtgtcgttcacctccagcagcatataatcctgcgtgatgggattgtaattcacggtagtaatgctggcgttatctactataatctccgcttcttccggatggtttctcattaaataggcgacaatataagccatggtcgcaccgtgggacacgaccgcgatgtcttcccggccgtttgtcatctccatgacggcttcgatggcccctgctacccgttccatggcctccatctgggtttcaccgccgggcggcgccacatccaccggattgatggaccagcgctcgtactctgccggatactgttcctttatctcgtcccaggtcatgccttcccatttaccgaattccacctcgatgagtcccgggaccagataagtctccacctgctggcggtcgccgatcatccgcgccgtctccaccgcccgcaccagcgtgctggaaaatatctttgtcaccggccggctgtccatcccctccgccacaagcttcgcctgggctctccccgtgtcatttaagggtatgtcgtgactgccctgaatctttccctggatattccagtccgtctgtccatggcgtatcagatatagtttcattcctcttcgtcctccgcagcctcggtaatttctattccttccacttctgccagttcttccagatccgcgttttccgcgttcatgctcatggcatccatggccatcttcatgatgtccttcacttcatctacagtcatcttcatcttatccgccagctcttccaccgcggcctcacgccccagctccctggcaagcgcctgggatacggtctgcagtacgttgactctggcagccagttcctctccggtctgctccgcggactcttcctcctccacagccagatcaagcgcttccttcatccgtgccgtcaaaaagccctcgaaatcaccgtctcccggattggttaagaattccgtcacggccatggtcagcgccatgttcgcctcggcgaccaggtccgtcaaaagtactccctttccgtcatacgctttcgcacaggttaaggcggcttccagattcccctcgatgaggcgcttcttcgccccctcattcccggccgcggcgtcatttaacagctgcgtgttctcctcctgcgtacagggagtgatcgctttcatttcttccaggtacatctgataaaaatcgtcatgcataaatcttactctccttctgactgctaagttgtaacggtttagacggctcatcttcttggccgataaaccggtcaagaagcatcggatatttttccgccgtctgaactgttacaccaagttaccataatctggtatttttgtcaatttcctttacaaatccatcgcattcgtgatagaatgtccttagatttataaggaggactaataatggatattaattatgaattgtataaagtattttaccatgttgctgccacactgagcttctccgaagcgtcgaaacagctgtttatttcacagtcggcggtcagccagtccatcaaagtgctggagaaaaagctgaatcagacgctcttcatccggagcacgaaaaaagtccaacttaccccggaaggcgagattctcttaaaacacgtggaacccgccatcaatttgattcaaaaaggggaaaatcagcttctggaggccaacaccctgaacggcggccagctgcgcatcggcgccagcgacaccatctgccgttactacctgattccgtacttaaaccgcttccacaaggcttaccccaatgttcatataaaagtcaccaaccagacctccatcgagtgcgcccacttactggagaacggacaggttgatttcatcatcaccaactatcctaactcgggcctctccaattctcagaacgtccgggtgatcaatgaatttcacgacgtcttcgtcgccaatcaggagtatttcccgctgaagggcgagacggtcagcctgcagaagctgcagacatatcccatcctgatgctggacagaaagagcactaccagcgaattcctgcatcatatgttccagcgggaacagctggacctggttccggagatcgagctaagcagcaacgatctgctgatcgatctggcacgaatcggcctgggaatcgcctttgttcccgatttctgcatcccggaaaatgacaaggacttattcatcgtcaagcttacggaaaagatgcccgcacgccagatgatcgtcgcctataatgaaagccttcccgtttcccaggcttccaaacagtttatggacatgatgtaagcgccccggcggagcgtgtcggaaagtgattttcacacacgcttcggcagggaccgcccggtcagcgccggttgtatgccatcagagaattcccccacatctcctcccggtaaggaaagtcttcctttcgatactcctcttcccggaatcccaccttttcgtagcagtgcttcgcgcctggattgcagtcgaataccttgagcgtcacccgcttcataccgagaagctccacagcgtacgttacggccatggacaccatctgctgccccacgccgcgtcctctcacctccggtgccaggacaatgtatcccatatggacgctgtccgcctcataatccgccgcagccatcttaaagcttccgaccggtttcccgtcttcaaccagggccgtaaagccccatgcacggggatcgcgctccagctccgcgtaataggcgtccatctgcccgtccgtcagcggaaatgtaaatccgtcgcggcaccacatgcgcatctgcctctcatcggagaaccatttcattacttccctgccgtcttccctcttgcagggccgaagtctcagtttcatcatagcctttgtctctccctttcttcccagaattctgtcacaatcccggacacgctgtttaagttcacggcgtaatagccatcccattccctggggaacagtgcctgatagtccggttttaaaaaacggtcatccagcagggcgatcacaccctcatcggacacggttcggatcacccgcccggccgcctgcatcaccttgttcatgccgggatactgatacgcgtagtcgaagcccttctgctccttctcatcgaaatatcccttaaggatctcctgctccgtgcacaccatgggaagccccgtccccacgataatcgccccgatgagccgtccttcctttaaatcgatcccctccgaaaacacgccgcccatcacacacaggcccacgaaggaatcctccctgtcctcctgaaactcctccagaaaaacctcccgctcctgttctgtcatgtgggacgactgggcgagccatgcgaactccttcccaccctcgtccagcccggtaagcagctgttccacctcccgcatatactgataggacggcagaaataccatatagttacccgcatgggctgagacaatcctccggatatactcgacgatcttcttgaattcccgctcatttcttctcgtgtagcggctgctgacgtcgtttgccgccagcaggagccgtttgtcccggtcgaagggggattccgcgtacacggcgtattcctcctgattcccgctcagcagctccttgtaatactggacaggcagcaatgtggcagagaaaaacacggtgctgctgcccttatccaggcactctttcaagttcttcgacggattcatattaaacagccggagcataaagcgtccattcgataaaaattccgtatagatccggtaattctcatccacccggtcataggtgttcagcagatcccggagcgcaaagtaaaaatccagcaccagatcgcggtcctcgaattccggaaagctgtccatgaatttctccatctcaccgaacagcgacatgacggcagtcataaacagtttgatatccgtcaggatcgtgtagccctcgcattcccgcttcatctccagcagctgcttgttgcaccggtctaaaagcccggccagcttctggtccttcggtttcacgatctttttaataagaagaaagtcctccttatacaccaccgcgctgtacatctccctcgccctgggcacgagattgtgcgcctcatctacaaggaacagatagtctcccgatattccctcggaaaaataccgtttcagcctgatattggggtcaaatacatagttgtagtcgcagatgataccgtcgacccagttgctgatatcgaggcagaattcgaaaggacatacccggtgctgctccgcatactttaagaccgtctccctggtgatccccgcttcctggtgaatcacgtcaaacaccgcatcccccacccggtcgaaatggcctttggcatagggacaggcgtccggattgcactccggcttctccagaaaacagagcttctcctttgccgtaatcgtaaccgtgctgaagtacaggccgcctttccgcaggatctcatacgtctcctccgccacaccgcgcgtgatggtcttcgccgtcagataaaacagcttgtccccaaggccctcgccgatggcttttaacgccggatagacagtggacagcgtctttccgattccggtgggcgcctgaataaacagattcttcttacgcgcaatgctgcggtagaccgatactgccagctccttctgccccttccggtaaggatagggaaattccagatccttaatggactcatcccgccgcaggccgtggtggtataagtaatcggcccacttcacgtactcgtggatcagtccggcaaaccagttttccagctcctcaaagcttttctccgactggaaacgcttgatctcttctgtctcgatattgcagtaagtcagctgcatcacggccccggtcagctgatgatcgaagcagtagaagtagccgtagcacatggcctgtgccatgtggacctcgatggggtcgttcagataatagagatccatgtagacgcccttgatctcgtcgatggtgacgcccgatggcttctcaataatgccgtcggcccggccctccaccaggatctcaaactgctcttcctccaccagatgctttaacaccacctccgcgtggtaatccgcccccatgcgccgctggatcttccggtgtatccggcttccctcctgcatggccgtcttctctgcccctgcagtccgcctgttgtccaggtcaccggaacgcatcacgaattccaccaggttacggaccgatattttaattactttcttttccccgtcagccattccggtaccctcctttcctgaacgaagttcttaaaccagcctgtgacagccatcataaccactgccgctgctgccagccccaccccgcatcgcggccggcagacagaaaaagggaactgtgtccccatggatcacaattccctttcctgtcgcttgtcgagtgtcctgctgcttatgccgcatgaatcctgctcggtgctttttccaataagtatgtttcgaattctacattctctccgttaaactccacggtaagagccttcgttaaatcaaggctcaacacacctaatatagactttgcgtcgatggtcactctattgtaatatacgtctatatcgaaatcacattttgtagcagcagcaacaaactcttttgcttcggcaacgcctggtaacataatcttatactgtttcataatcatgactccttctcaaaataaacagttaaaaagttgttgaaacatttatatcacttctgacgcaatttgtcaaattacgtttcatgaagagaaatgtcaccttttcttgtgcattttgctttgtttgaaggatgtctgtgatttaccactatgcacttttgcaatcaccaaatactaatgtcgggaatgattctcatttataactttgtacgtcatctatttttacagaaataccctattattttcatataaaacgaccagagggttcgtgcctccccgcacaactgtccgtattacagggacatgccggtaaaaaacgctcctctacctgttttgatccaggatcgcctgcttcaccgattcgaaggggacaggcgcataaccgatccgctccacacaggcgcagaagctcctggcggatacgtcctggtacatgggattcccatgtacatgaccgaagatattggcataagggctgttgatattcacatacacaggctcatgggacaggatgtaaaaatcatccagcacggcaggcagaaaatacacctcatcgaagccaaagtccagccagtccctggtcgtaaacatccggtcatgattacctgcaattagtatctttctcccgttcagccggttcgcaatctccttaatctcttccctgctcaggtagcaggcaaaatccccaagatggtacaccgtgtcctccgctccggccacacggttccagttctcgatcatctgttcattcatttctcttccgtcctgaaagggtcttccctcatatctgaggatggcccccgaatcaccaaagtgtgtgtcagaaatcagatagatatctcccataattcctcccggctgtttttacaaatacgaattcgtttagtatatcatattccccaggggattaacagcaaccgattcccgggcacatcacagtctcaaaaagcccacggatggtgttccggcaggcactcgtcacagagcagctcgccgttcaccgtcgctccgttcgacaatccccggatcggatcaggcttctcccggtccgtggtccagccatgacacttcgcgcactggccgcagttcatcgtcagcggatccagataaatcgtgctggttgactgccattccgccttatgctgatcatccagcacaatctcctgctccggcagtttgccccacgccagcttccagaacttctcttttcccttgtggtcgctgacctcttcttcatccacttcaaccagataactgatcttgtatagtatcgcttttttcatataggcacctcatcataaagtggtcttcagcccgaacgtatattctttttaagattataacacatccggtattcaaagggaagcataaagaatacgtatgccgctcttactccgtaaaaaaagaaaagccggaactccttactgatcaaggactttccagctttttcttatccgttcacgctttttactgagcaggggaagaggggctcgaacccccatttacggttttggagaccgttgctctaccattgaactattcccctatggcttgtttcattcatgtttcatctgaacactatgagagtatagcatacctgtttttaaattgcaacagttttttataaaaaatacaaaaattcgaaagtttatccagaaacgggggactgccgccggcaatcccccgtgttaaggctgaatctcaaggcttatttatccagctgaaatctggagacatagtccttcagcagctgtgcctgactcgacaattcctcgctggccgctgcactctcctccgctgtcgccgagttggtctgcaccacggaggcaatctgagtgatgttcctggtaatctcggtaatggagcgggactgttccgccgatgccttcgatatccggtcgaccgtatcggtcatcttcacggattcctgggccacggtttccagcgcctgggccgccgtgtcggcgatccctgccccgtgcttcacggatctgaccgacttttcgatcagctccgcagtgctcttcgacgcctcggcgctctttccggccagactgcggatctcctccgccactacggcaaagcctctgcccgcgtcaccggcccttgccgcttccacggccgcgttcagcgccagcagattcgtctgaaacgcgatgtcttcaataaccctgatgatctccccgatctcgccggaattcttccggatctcgtccatggccgcaatcagcttcttcatctgctggttctgctccaggatctcaccgcccagttccttcgacttatcgctggccgccttcgcattccccgcattatgatccacctggttggagacctcatgaatggccgcagccagattctcgatggctcccgcctgctcggccgctcccagggagagggactgggctccgaaggacagctgtgccgccccttcggatacctgatcagcgctctcgtagatccgccccagcgtatcatttaaggaagcggcgatttcctccagcgcctccttgatcttcccgaattctccctcatagacaccgtctaccgtaaggcgcaggtttccgtcagagagttctgcgagaaccgttgtcgcattggagatcatgtccttgagagactggatggtccccctcacactggccgccagcaggccgatctcatcgtcgctgtcgttcttcagatccacgctgaaatctcccctggaaaagccttccaccttgaccgcaatgtcgtaaagcggagaaagaagttttcttaccagcctgatcactatgaccataaccgcgatcagtatgagaaccgagatcaccaccatgaccgcgatcagctgattcctgggggcattgatctcctccaccggtatgctgccgactgtggcccatcccgtcgcttcgctcttcgcaaagatggagtaatactttttcccttcatatctataagtcatggctccggtatactggttccggatgccgtctatgtattcctggctcaggttatccacctcatccaccgtcctgttaataaggctggcatcgaagctgtataccagggactcatcgccggtaaccagttccagcgtgccgccctttccaattctgatatcctggagcagctgcgaaaaatggtcctggaacacgtcaaatccaacgtatccggtgatactgctgtcatccagagagagaaccggggccacgacggagataaccatctttccggtaaccggatcgagaaacggatccgtcacgaccggtcccatcgtctccagaacctgttcgtcccaatcgataccggccagatcggcggcccacgcttctccggtctgcatcagatacgtgtcgttgccgattccggccagccatacggcctgcactccgtcggaaaccatggtgtcgtaggcccgctccagcagcgtaaccgccgcctctttccccggtgccccggcaatctgctccgcggtcggcgcctcttccagcagccggcgaagctcttcattatagcttaaaattcccacggcgctcttcttgccgttaaagaactcatctaccgtgtccaccgcattcttggtctggccctcagtcacctgatagctcaggttggtaaccgccagcgcggcgatatagcaggtaacaaaaatcagaactgccagcgccgggaacaggatgctgatcaggcgcttgttaatctttccggatacggtcgcccgtttttcctttcgccccgtcttttccggcgtgtgattctttgctttttcaacattttcgatcattttgccccctccttactgaccattataatacttaaaggtataacgggcaaacgatttgtaaaaaagttccggtaatatgccagatacagcacagatacgccaggcgccggcccaggccggttatccgatcgcatttccggtatacagctggtagtaccggccccgttccccgatcagttcctcatgggttccccgctcaataattctgccctgttccaggaccatgatgcagtctgaattgcgcacggtagacagcctgtgggcgatcacaaatgtggttctccccttcatgagccggtccatgccttcctgcaccagcgtttcggtgcgcgtatcgatggaggaggtggcctcatcgagaatcagcacaggcgggtctgcaaccgcggccctggcaatggagagaagctgccgctggccctggcttaagttcgccccgtctccggtcagcatggtatcatagccatccggaagacgtttgataaagccatgggcattggccagcttcgcggccgcgatacactcctcatccgtcgcatcaaggcgtccgtaccggatgttatcgataacggttccggtaaacaaatgggtatcctgaaggaccattcccatggaccgccttaaatccggcttcctgatcttattgatattgatgttgtcatagcggatctttccgtcctgaatgtcgtagaaccggttgatcagattggtgatggtggtctttccggctcccgtgcttccgacgaatgcgatcttctgtcccggcgtggcgtaaagcctgatgccgtgcagcacgatcttgttgtcgtcgtagccgaaatccacatcgttgaacgtcacatcgccttccagctttgtataggtaatggtcccgtcctccctgtggggatgcttccacgcccatatgccggttctctcctttgtttccgtgatgctgccgtcaggcgtcatatccgcgttgaccagttccacatagccgtgatcttcctccggctcttcgtccagcattcggaaaatacgctccgccccggccatggccatgacgatgctgttcatctgctggctgatctgggtcacaggctgcgtaaagttcttattaagcgttaaaaatgaaaccagcgttcccagcgtcagcccccaattgccgcccagcgccatgaccgcaccgacgactgcacaaagcacgtagctgatatttccaaggttcccgttgacaggcatcatgatattcgaaaacttgttggccagattggcactctcccgcagctcctcattgatcctgcggaactgctccagactcttctcctcatggcagaacaccttgaccaccttctgcccatccatcatttcctcgatgtaaccgtttacggttcccagatctttctgctgccggataaaataggccgccgatttaccgcccagcttcgatgtggcaaacagcatgagccctgtcatgataagcgtcaccgcggtcagcggaatatccagcacgatcatgctgaccagcgttgtcacgatggtgacggctgaacttaccacctgcggaatgctctggctgatcagctgtctcaaggtatccacgtcattggtatagacagacataatgtcgccgtgcgcatgagtgtcgaagtatttcacaggcagtgactccatgtgggtaaacagctccaccctcagctttttcatggttccctggcttacattgaccataatccggttgtaggcataggcacacacaacgcccagcccgtaggtgactgccagtgaccccagggcggctgccagagatgaaaaatccggtgtccgggcactcgtaaggggcacaatgtagtcgtcgatcaggctctgcataaacagtgttccgcgaagcgtggccagggccgcccccagaatacagaccaccaccataaaaaacgaaaatttataattcttcagcatatagcccaggatccgtttcatgacatggcccagcattttcgtatcactcttttggcccttcgtccctgttctctcttctgccatgctctcacaccatcctttcctgtctctgccgcagccgaaggctggtcaaagtcgccgccgcccttcatctgcgtctcatagatttcacagtaaatttcatttgtctttaacagattctcatgggtatcgaagccgctgatccggccgtcatccagcaccagaatccggtccgcatcctgcacactggagattctctgggcgatcaccagcttggtggtgccggggatcttctgcacgaaggactcacggattttcgcgtccgtagcggtatccaccgcgctggtggaatcgtccagaatcaggatcttcggtttctttaacagcgcccgcgctatacagagccgctgtttctgccctccggagacgttattgcctccctgttcaatccaggtttcatactgatccggaaattgttcgataaactcgtctgcacacgcctggcggcacgcttccctgcattcttcccaggtggcgtcctccctgccccagcgcaggttgtcgagaatcgttcccgaaaacaggacatttttctgcagtacgacggccacctggtctctcagcacctccatgtcgtagcggcggacatcatttccgcctacgcggacgacgcctttgtccacatcatagagacggctgattaagttcaccagactggattttccgcttccggtaccgccgatgataccgatggtctcacccggcctgatctgtaaatcgatgtcatgaagcgtctcttccccgcttccgtgcttataggaaaagctcacatggctgaaggaaatgcttccgtcgggaatgctcataaggggattctccgggttcgtcaaatccgccttctcatccagcacctgagcgatacgccttccgctggccgcactcattgtcaccatgacgaagatcatggacagcatcatcagggacatcagaacgctcataacgtagctgaacatggaggtcagctctcctgtcgtcagtccgcccacgacgatgaacttcgcgccgaaccaggacagggagatgatacagccgtagaacaccagcatcatcaccggattgttgagagccagaaggccctccgccttcacaaacaggcggtatagattttctgcggcccttgtgaatttgttattttcgtgttcttccctcacaaacgccttgaccacgcggattgctgatacattttcctgcacgctggcgtttaagtcgtcgtatttgcggaacacttcgtcaaagatttttgtcgtcctggtcatgatcagccccagcgcagccgccagaaccacgatggccgccaggaaaatcaggctcagtcttacattgattaagaagcacatggccatgctgcataccagcattaacggcgccctcaccgcgatcctcagtatcatctggtaagagttctgtacattggtgacgtcggtcgtcattcgggtgaccaggccggctgtactgtacttgtcgatgtttgaaaatgaaaatctctggatgttttcatacattccgtctctcaaattacaggcaaatcccgacgaggccgctgccgcatatttccccgccagaacaccggacagaaggcttaaaaatgccataatgagcatcagccctccgtagaaatacacctggccgatgttcccctgttcgattcccttatctatgatggaagccgttataaacgggatcagcacctccatcagcacctccagcgcggtaaacagcggagtcagcagtgactcctttttatactgtttcacctgcttaagcagtgtttttatcatagttattcctcctttacacaatctgtttttatgtttgaaatcattctgttcaaggtgtatgtaaagagctccagttcttccccggagagcccgctgcatagccgctccatctgccgtttcaggacgctctcgatcgtctctctggccctgtacgccttcgcagtcagggtgatccgtttcttccggtcgtcaccggagaccgccctcatctcgatataaccgcccttcttcagccccttgagcatggaagagatcgcggctctggaaatcccgcattccgcgtggatatccgtggcatacgtggcttgttccccgcaggagaacagataattcagtacccagccctgtgacggagtaatatcctcactcttcatctcctcccttccatactggtccagggaaatattcaattgtttcaaaagccagatgatattactctcatacatgccttttctaactcctttctgattattcggcccctaactgtttcatggttaacagaccggttacgaatgattctactcgattttcccttgtaagtgaattcaaaaaatgttatcatcaataaaatacttttattaatcagaggaggtaaatccatgaatacttttcaactttcctgctttctggctgtcgcggagacgctgagtttcgccagagccgcggaacagttaagcatcacccagccggccgtcacgcatcagatccactccctggagacagaattgaatgtgaagctcttcgtgcgcaccacccgcacggtgaacctgacacaggaaggcacgctctttttaaacgacgccaggaacatactcgccctgaccatccgggcaacaaaacggttcgagaatcccctggaacaggaaatacaactgttctccatcggctgccacagctactcccacatgttccttctggccgatgttctccgcctgctggccgcctcctgtccaacggtgcatccagagcttcgcgttgtgccgttccggcagctctaccgtcttctggaggaggaagaggtagatacggtcatcggatttcaggagcctgactccagaaaagtacccggattctacaaagagctgcggaaggtcaccatctcctgtgtctgctcccgggacaatcccctgtctgccctggaaaccgtgacggtggcggatttagaaaaggaaaaactggtcttaaacgatccggccaagacgccggctgctgtcgcccagttccagggacagctgatgggcggccgttccccttccgacttctacttctgcgaatcctgtgaagccgagacggtcctggtaaaggccggctacggcatctctgtactcccggatctgctgattcccccggatccctccctcatccggattcccgtagccggactggagccgctctccttcggggcgtattataagacgcttcagggaaacgagatgctaaagagctttatccgcatcatgaaggagcactttccatatgccaggtagtagagaaaagaatgcttcggaaggcttttgttttcctggatgcctcttttttgtacaaaaagactccggcaagccggactctcgcgccggagcgcggccgcttcagcggccatacttccttagcacggagtgcgcatcctcccggagggtttttatttcacagaacgaactttcctgtgaaattaaaaaaagcggtatggggaatcgaatacagcttccatcgatgttctccatactgctttattctattgatgccggacaggccatactttcccggatcacgtatcgatcctgaccatttccttcacggctttgatccggtaaatcagatcgtttctcaccgtaaatccgcggttttcccagaatttgttccctgtttcattgcggtcaaataccaccagagcgcttccaattccccgataatcctctattctcattttccttatctgcatggctcctctagtccctcatgaaagggctgataaatccgatttttcataacggttgtgtccctgaatcccttttttataattccagcaccgaatcgcctcatccagggtgcgtccttcattgtccgcgaagaaatcccggatatacgtgttgtactcgaactgccggccgatcgttgtctttccctttttcttttcctccagaatctggccgtaagcgtctatggcctctctgtaggtttttcctgtgttgcttttcagccatttctgaaaggccacgttaaaggaaaatccgctgccgatagcttcccggaaaaaggcccggtgcttttcactgcacacgaaatcaggttcaatcttcctgtcctcgctgatcgctcccacatccggcctgctctttgtctttgcagaagccgggagcacatctcccgtatcgaggaaacaggcgattctctccgtaatctcgatcttgccgccggagacaggcagcccgttttccctgcaaaatgccgccagctcttccttcagataatagtagcttctaaaggtcttcccgtccagcgtcctgtccagcctgggccgctcactcatgttcctgctcctcccgcttcctcatgggcaaattccagcttttccacctggtatgctctgccttcgatggtcattaccgccatggtgatcggctgatgaaaccgtctcggaccgcagcttcccggattcagccagagcgtgccgtcgatgacccgttcgtcgtagcggtgggaatggccgtacagaaccacatcggcgccggatacgccttcgggggatgccccttttttattgtggaccatgtaaaatgacacgccctccagagagaagctcaattcctccggcatcccctccgcccactccttatcgttattgccgcgaaccacatagaggggcgcaaaggcttccagttcttttataatggtttctctgtttatatcgccgccatgtaaaattacatcgcacgtctttaatacatcttttacctgcggccgtaaaaggccatgggtatccgacagaattccgactctcataccagctttcctttctttcattattatggtgatggctgatgcactgccattacaggttttgccgcaatggcagtccccactctatttatcactcttacagcagtgaaatcgcctcccggatattttccactccgaccatgcggattccctccatcttcctcatcttgtccagtgaggtcttcgggagtatacacgtctcgaatcccagcttcttcgcctcattcacccgctgttccgccatgggaacggcgcgcacctcaccggccaggccgacttcaccgaagataatcgttctcggattcacaggcttgtcctttaaactggagatcacggccatgacgatggccagatccagggccggctcattcatccgcaggccgcctgcaatattcacgtaggcgtcataccgggatagctcatagtggcaccgcttttccagcaccgccatcagcacgtttacccggttataatccgtgcccgcggccgttctcctgggcataccgaacagagtaggcgttataagcgcctgcacctctaaaagcaccggcctcgtcccctctaaggaacaggctaccacggcgcctgacgcgtcctccggccggccgctcagcatgtattccgacgggttcttcacctcttccagcccgctttccctcatttcaaagacgccgatctcgttagtggagccgaaacggttcttcacaccacggataatccggtaggaggcgcttctgtccccctcgaaatatagcaccgtgtccaccatgtgttccaatactctcgggccggccaccacgccttccttcgtcacatgacctacgatgaaaatggcgattcccactccctttgcgatctggagcaggagattcgtggattcccgcacctgccccacgctaccgggagccgaagtcacctcttcccgaaacatggtctgaatggagtcaataatcaccacatccggcttctccccggagatggcgccctcgatcgtatcgagattcgtctcacagagaaatttcagttcccctgtcacagttccgatccggttggccctcagcttgatctgctttaacgattcctcgcccgaaatatagagaaccttctgtcctgatgcggccagattcctgcacacctgcaggagcagagtagacttgccgattcccgggtctccgcccaccagaacgagggagcccctcaccacgccgccgcccagcacccggtccagttcctcgtatccggtctgcatgcggtcctgttcatccagcgatatctccgatagataggaaggcctgatctttgacatgccgccttcccctgcgccgccctggccgttcccataggaagctccaagacctctcttcgccgccggttccttcttcgccgtcagctcttccacaaaggtgttccactgcctgcatccgggacactgtcccagccatttgggcgattcgtatccgcattctttgcagaaaaatgatgtcgctttcgcttttgccatgctgctcctttcctactaaaaaagaggctggtaaaccgccagcctctttctgccattctgattttatcttcttacgactttaacagacacaggttcttcctcgttcagttccacactgacagacagcttaccgctcatgttggtcatcatgcttcccactgccgcgtcgtccacaaatacctcatattcggtatcatcctccaactgaatggtcagctgcgcgtccttgtctccttcgacggaaaactccacgccgttgttcgaaacggtaaaatgttccacagcggttcccggcacggactcatagacaaacatgccgttgcgctccagtttcgtaatctcataaaacgtctttactttatataaatcaccatcgtgctcaaaatcctgtaattttgactttgtgcttaacttgtaattaccaaaactgattgttccatcctgctctgtgcggattaattcttcaattaccggcatctgtacgccctcctagtattcttgtttacttatcctttttgcgaagcgctctttaatgatttcgcttgtcatcattatacacgaaatcaaatcaaatggctagttctttatgagctcgggaacagaaaattttaactccgattctccctggctcaccagaacttcatccccttctttcaccgctccatccagaatttcctctgccagcctatcctcaagactgctctgaatggtacgtcttaacggccttgcaccgtatttttcatcatatcccttgttaatcaggaactcttttgcagcttcatccacggagagtgtgatgttcatctgttccttcgtccgcttcatgatttccttcagcataatggtgacaatgtccttcatgtggcccttattaagcggatggaagacaatgatctcatcgatacggttgataaactccggcttgaataaatgctttacttcctccatcacacggtccttcatcaccttgtagtccgccttctcatcggcgaccgctccgaagcccagacgtttcggggaaatgatgctctccgcgcccgcattcgacgtcatgataataaccgtgttcttaaaatcgatcttacgtccctgcgcgtccgtgatatggccgtcgtcgagaacctgcaggaggatgttgaatacatccggatgcgccttctcaatctcatcgaaaagaatgacggaatacggatttctccgcaccttttcgctgagctggccgccctcgtcgtagcccacatagcctggaggggaaccgatcatcttggagacgctgtgcttctccatgtactccgacatatcgacacggatcagcgcgttctcggtgccgaacatggcctccgccagtgccttggacagctctgtctttccgacaccggtgggccctaagaacaggaatgaaccgatgggacgcttcggatccttcagccctaccctgccgcggcggatcgcctttgcaacagctgtaaccgcctcctcctggccgatcacacgctcgtggagaatggattccaggtttttcagtctctggctctccccttcctccagctttcttacgggaatcttggtccagctggagacgacatcggcgatctcttcctcatcgaccacctgcttcttggtgtctttatccttctgccatttctcacgaattttatcgatcttctctttcttcttttcctgtttcttcttgatggtgcccgccttctcatacgcttcgtcccggattgcggcttccttctgatcctccagcttctcgatctctttctccagctccttgatctcgggcggctccacaaacgcggtcaggcgtaccttggaagctgcctcatcgattacgtcgatggccttatccggcatgaaccggtcgttgatatacctggcggaaagcttcactgcggccgtaagcgccgcatcggtgatcgtcacatggtggtgcgcctcatagcggcctcttaagccctttaagatggctatggcctcctcctccgacggctcctccacggtaaccggctggaaacggcgttccagagcggagtccttttcaatatacttgcggtactcctcgatggtggtggcgcctataagctgaagctcgcctctggccagggatggctttaagatattggaggcgtcaatggcgccctccgcgcctcccgcgccgatgatcgtgtggatctcatcgatgaacagaaggacttctccatcctccatcacctccgcgatcaccttcttgattcgctcctcgaactcaccgcggtatttggatccggccaccataccggataagtccagcgtcagaacgcgtttctccgcaatggtttccggcacatttccctcgataatcatctgggcgaggccttccaccaccgccgtcttaccgactcccggctcaccgatcagacacgggttgttcttcgtcctacggcttaagatctgaatcagacgcttgatctccgtctcgcgtccgatcaccggatccagctttcccgccctggcaagctccgtcagatcacggctgtagctgtccagtgtgggcgtactgccctttgtcttggctccctttaacagctcctccttgttggccggagcgtcctctcccatggccgccagaacgtcaatatagagcttctggatgctgatgccgatggtgttgagcagcctggaagccacgcagtcgttgtcccggataatggaaatcagcagatgctcggtaccgatcagtctggccttaaaacgcaccgcttctttgtagctgttctccagcactcttctggcgctgggtgtataaccgctctcctccatacggaccgtctggtccggagagatgagctggctcacaaggctgatcaccttctctttcttaacaccgttctcggaaagcaccctggcggccacaccgccgccttcctccaatagtccaatcagcagatgctcggttcccacgtagctgtggcccagctcctccgccgcctggacggccagattaattgactctctggcctttgctgtaaatctgtctatcatgtcagtctgtcctccttgttatgagcactccgttcagctcgtatgctttgttgtttcacggaataaaccgtctttactctaaatcaggcaattctccacggataaattccgccctcgcaatatccagttcttccttgcttaacggcctgtcggatatcttctgtaaattcgccggctgcaggccgagcatgaggcggtagacggagcacggctccttcatcacaagcagcccgtccgccgctccggccatgacctgagacaaaaatatcataccgtctctggccgtaagcctcctggcatattttaacacaccataagatttatatacctcgtcctcccgttccaggcgccgccgctggagggacatcttcctgacggtcatctcctggttggtcaactggatggccgccttcgtcaccacatcggcgatctccttttcactctgtcccagcgtcttctggttcgatatctcataaagggagccaaaattctcctccccttcgccgtacacgccgcggactgccgtcccaaaccggctcatatcggctatcaaagccgggaacttccgccccgaggacagcattggcagatgcaccaccaccgaggccctcatcccggttcccacattcgtcggaaaagaagtcaggtagccgtaccggtcgtcaaacgcatacggaaaccgttcgttgatgtaatcatccagggcatcggcccgctcccataattcctccagatgaagcccggaagagaaaagctgaagccggatgtgatcgtcaccgtttagcagaatgctggtatcctcgtcctcagacagtatgatacccgccggggctttcttctccaccgcagcacggtttatgattctccgctcccgcagcgccgcccggtccagttcctccagttcctccagcatggcgtattcgtatttcctgccttccacctccgcgagatccttcagcccgaattccagcctgcggaccatctcctcgctctcctgtgtccccagcatggcagggaacttatactcttcccagtttcgcaccagacgaatgcggctgctgatgacacccggccgtttttcgtccgtcttttcaaaccatctaagcattcgtctcatgtcctttctttaattccctgatcttgtcacggcataccgccgcggtctcatagtcttcaaactgaagcgcttcttttaacttcgcatccagctccataatctcctcttcatgttcataaacggcatctcccgccgtctcatccccgctgccctttaaatccggcgttttataggaaatcttctgatatttcggccgcttccccgtatgtgcggtgctcccctgcagctgctttaagctctcttccatcagggggccgaacacactgtagcagtcggcacatccgaactggctgttcttgataaattcatcgtagctggtcttgcaggtcggacagaccacctggtgcagcttatccggcacccggctggtatcctcgattcccaggagtcccgacagcagcttgcccagcggaaattctccatcaaaaatagcggaatacggtccaaaatccatctcttttgcacattgggcacagaaatggtgttcctttttcacgccatttattacctctgtatactggatattcgcttcgcgaatcccgcatctctcacataacataagtaacctccattcttccggctattcctccttctgacctctggaaaacagcataaaaagctcatccactagctggtgcacctcgtcacaggtaacattcttgcagattccgcgagccaacacgacgcttaaatctctcctcatctcatcgaggacgcgcatcttatccacatccagggccacgaccgcccccttgcggcggtccagcttaacaaagccctcctgctttaagacagagtacgccttattcaccgtgtgcatattaattcctatattgtcagccatctggcgcacggagggcaggggatccccttcctttatcgtctccgtggcaattccaataatgatctgattccgaagctggatataaattgcctcatcactgttaaaatcgatttgcaatatcatatattcaccatctttcgttatatctgttatacacataatagcacacaagaattgttttttcaatatgtaatatatttacatcggacattccttaaaaagaaccaatgaaagctctactattttagtctattgccaaataatactatattttttaaaagtgataaacagaatgcgtattgaaaccttgagtttccgcaaattgtaattgaaaaatgaatatagtaatcaaaggtgccaatctgccgttttttgaaatgctggcgagtggcagaataatgagtagaggcactttaacaagccccgccggaaccggactttgggagatttattcttttatctatttaagcggtcagcttaaggctgagttgacggtatgcaggacgttttgtcctgaaccagagtctgacgccctcttttgcatacgacagtatgccggagatcccttttgccagccgataatagcagaaatgcactttttctttcaccggatctgctgtctttataatggaaaccttaagggcattcgtctctgatttcatggtgatctgtgcaaggaatgccatgcataaggtaatataaaaatttaatgcgtttatggctttgagttttcttaccctgaaattttcaaactggaacatctgttttttacaccggaaatattcttcgatccgccacctggaaaagtattgctttgctacagcgatcacatcctcttttgaacggattggtttatttgtggcaagcatcataggatgctctgtgataccataaaccagcaccagataaatgtcctttctggaggcggtgatctgtaccttcacatgggaaagataagcttcgtgttcttttcctttataaaatagagggagttttacttttcctttcctacggttacgcagctccgttgcaaaagtccatttattatggtagagcagcttacgtttggcagtaaggcgtatgacatagtcctgtcccatggaatccagcttgagaaacatcttgttatcatcatagccacggtccatgacaaaagtcgcttttccaaacagggaattggcccgctccatagcggagaatgtgacatcgttaatggaggtaaagtttttttcaccagaagaatggatctcggaaaagagactaagcggatgattgttgttggtgaggaccgtggcttcggtaacatgatagccctttttatagagattttttgtggcagtgctttcggaaccatcacgtacccatccaagcgattcaaatttgtaaccatcaggcttaacaacatcactgtcgtcgatatggataacgggctgagcaggacaccattttttaacctgtgtgaggtaagctttcagagcttccccgggagtccccttggcaaggtggtgtgaaaggcggtcaacaatgttgatttttttggaagtttcatggagctggtcaacaatatccgtaagcaggcagcttttggaagcgaggataccataattcatttcagcaataaatttgcgttccggtttaggaagctttcttgaaaatttatttgaaaaagttaaaatttcccgtttcatttggtaagtatttgatgtaaaataagccataaggaatcccctttctttttgtttagtaagatttttgtttggtagcttaattttacatcaaaaagggataggattccttatattttgggcatttttttaaagttgtgtataagtataaacagtaatggtgcttctgtggacagaactgcggaaactcgagtattgaaacacattgacattatacattgatattgatataattctatatagtggaggtgatacaatggatttaacgaaaagcgaattagaaataattgaggtattatggaatgcaaaacgtccattaactggaacagaaatagtgcagctatctccaaaagataaatcttggaaagacagttctattcacattctaatcaatagcctattgaaaaaaaatgctattaaagaatcggggtttgtaaaaaccggaaaaagctacggtcgtaccttcacagctaccgatcgatgtgaagaatattacgtagaatatttagcctcaattgtaaagagaaccagtttaaaaaaactattcgccgctctttttgataattcaaaaatgtcggaagaaaatattttcgaattagaagagttattaaaaaaatataaaggagagattaaatagtacatggataaaattagtatcagtttttattctatagttagtgctataattttttttaatattggcatgattctaattttaattttcagacatagtcttttctttctggtgaaatatggtgaatggtgtttactattactatttatattttcagtaatcaggatattgttgccgcttgactcagtaaatgcaattgtcattcattcaaataaaatatatccaggtataataaaaatgttacatatgccgttactaaacaatcaatatagtttaggatatatacttctaatcatttggataacaggaattatctttatgatattaaaggactgttacctgtattttaatgagtttcgatacataaaaaaatttttattggtacatgatgagcaagtagataggatatctaaagagattttttttaaaaatgttgaaatatttgtaactccgaatatttctgtgccaaaagctactggtatcttaaaaccatatatctatcttccgccgcttcatgtatcagacgatgaaatgcgcctaataataaaacacgaaatatgtcatatacgtggcggagacatagcaattaaaattcttttttctatattaacagacatattttggtggaatccattcatgtatatatatcaacatgaagtggacaatcttctcgaacttagatgtgatcataatatcactgagaatatggaccaaaaggagaaggccacttatttaagcacaattttacatgtaattaagcaatcaaaaagttatacggataattatttgacccgaagcgtaatgaattttattaattataagaccgaagatattacaaaacaacgatttcaggttattatgcgaagaaaaaattattggagatcagaaaagtgtatagttatcaatagtcttgtatttgttttattcatagcttccttttttattatagttcagccagcttattatccagaaaggaacgaggcagatcatatacttgagattaatacaataaattcatatattttactatcgaacaatgactatctactatatattaacaatgaaccctatggatatttatctgcttctgaattagacacattaccatattctgaattggaaattattaaggaggagtaattatgaaaaaagtaaaagtaattatgttaagcgctgtaatatgtatgctactcatttttcccagttgggcatcgacgtctaacgttttaaagcaaccagaggtggcgttgcaaaatgatgtaacaaaagcagaagttacaaaatggtattatagaaatattgatggtgtgaaagaaaaaagattatggtcaattacatatggctattggaagacagagtggatgcctgtttaaatgtagttccctctacattatttgtagagggtattattgaaactatagattgatattatcatcattctataatatttatcaaactgcatttattaatattaataagacttcaatactttttgggtgtgtactatttatgtctggtaaacaaatcatctgcaaagggtgaagtccctatcagcggtcgtttcattttcttaatcaaaaaaagtgggttgaccgtaaacaggaagatattttttattcttaggttatccaaaacaatgtctttgtcactgactctaaatctgattaaaggtacatgtttttaccaatcttatcggaaaggaaagctagcttatgggcatccggcgattgctgtctgctaaatcaaaaaagtttgtgtatatggaaactatttttttcttacatacaggcattattggagcagtatatactttatacctattatcgttaggattaactatatttcaagctaatttaataagtgctatttttaatatatccacgttaatttttgaagtcccaagcggtgttatgtgtgatttaattggaaaaagaaaaactgctataatggctggagtatcattgtttcttgcaatgttatgttttttaacaagtatcaatatttatcttataattgcaggacaacttttgtggggaggaagctatgcacttgagtctggaacggttgaagcatggctcgttaatgataactttttaaagggaagtgaacttgatagtgttttcgcatcatccaaaaaaatacagagcattactatgattgcaggtagttttataggaacatggatggcagattactcgcttaagctaatttgggttgctccttgtatttcatcgattttctttattataatggttataaagtttatggataaagtcgagactataccatcaaatacatctgttttagagttatataaaacctccttaacctatattaagaatggacagcagttaattgtaaagaataaaaaactttcctatatatatacgttaattatattaatgggctttatttctgcaccccttatgattttttggtctgtatatttaaatgaggttgattcttctttttcatatatgtatctttccacaatatggcttttaattcaaatttctataataataggaaatcaaatattggaattgacaggtaaatattgtggacggcctaaaatcttaaaatacactttttttatatttgggattagtgttttattcatgaataccagcaaaggaatatatgtggttgcatttttgatttgcatacaggaaatagtatggacgatgatatgttctgttcaacgtggtttgttaaacgattatatagatgatcgaaatagagcaaccatgttgtctttctcttcgttatttaatgctattggcaaaataatagcatcaatatcgtttggttttcttgctgatatgttttctattttgtttgcttggacagtggcgggtatattatctctatttactgtatggtttgttcacgtaatgtataaaaaaatatcttgacactaaaaattaaattgtatggaggtatatgaacatggcaaaagtagcatttatttcaattatgtggcattctcgttttgtagaagaactaggagtggagtatttaaccgccatcctccggcaagaaactaatcatgatgttaaaagttttattaaatttcccgaggaaaattatgatgacttttttcaaaaagttattcgatttgaaccagatattattggcatatcactttcacataaatatacaggattagagcctttgtatgcgggagcatctttattaaaagaaaaattaccctcttcttatttgtgtttaggaggtgtatttgcatcaacaaatgccatgaacattatgaataaaataaaagaagttgactgcattttcctgggtgaggcagaaaatataatatcggaatttataaatagagttattaatcatcaagatattagtaacctcaatggtattgcatatcgttgtagtgatgggattattaaaattctacataaaacacaattcattatggatttggacacgattccgtttccagcaagagattatatggaagaagattggtttaaaaacgctccttttaaaatggttaatattatggggtctagaggttgtcatggacattgccatttttgcaatgttcctagtatgtatgctgtttatggtacagaccttaaatggcgtggaagaagtattgtaaatatcctgaatgaaatggaatatttatatagagagcatggtgttttgatttttagctttaatgacagtagttttgaggactgtattccattagcagatggaaaaaaacgtctcgctatgttttcacaagaaatcatcaatcgaaatttgagaatattatggacatgttgttttagagccgagacctttaaaaatacaaaagaagatactgcgcttgtcgatctgatggttaaaagcggtttatacaatttgctaattggagtagaagcggggaataaacgtgcactaaatactttttcaaaacgtgctactgttgcggataattatgaagcaattaaaatatttgaaaagtatcctgtctacatttcaaaagggtttattatgtttacacctcaagcaacacctgctgtattaagagataatctagaatttgctcatgaaattgggttagaccaagaacttatttacttaacaactaaagcagcagtttttgatgagacaccttatgtaaatgatttgcagaatgaaggctatttagacttaaaatatgattgggaaaatgagtatccatataaatggaaagatgataatatcagacaatttgcggaggcgctccaatttatccgtgatgtttatatggataagctagagtacacacaatattatggacggaatgcaataatttggtatcgtttcgcggaaggtcgttacagtaatgaattggaatataaccagtatcatgtcaatcgattaagagaaaaaatgggtacttataattatgcatttatttctaattgtatagatttatgtgaaagaggatggaatgttcatgaatatcgtattataaaaagtaaatattttgatcatggatttttaaaagtttatgatgaaatggtattacagtccaagaaaatctcacgattattaagggaacatggtattactatgaatgatatagcaaatcctgggtgatttttgcttttgatataaaataatttgacagtcaaaagggtatgattaatgccctcacttttctgatatgtcccttgaaaatagaatatattgctgttaacaagacagattgcgctgtgactgtactcttcaacgcgaatcggcaggtattaccatcggatgttttatgcaattcttacgtttgaaacgcactgtcccaagctctgcatgtatttgcagaacttcttgatgttcaatgctccaattttacagccaaagaagaacctgctttgaatcaaacctcgcacggaaatcttatcaatgttatacttccggcgcagaatggaggggatagtttctaactccattccgatagcagctctgttgtttgaattctttcgcgctgcattcccgctgatgttttgccctatttgccagttccttaataagaagaccaccaatctggatattaaccggtgtgttcggtctcgaatccttaccacgatacagaacaacgtaaggtttttcatctatattaggaaaaatatgttccgcaaagtaccttgcccatgactggctgagaaattttttctctcgttcggtcagaatgttaaaggaatcaaaaagagacaactgctctacgccttggttattaaggacaaatgacatataaaagcctccacttcataatcgttgattttattttccagaaatgatgtgtgaatgcttctattttacaacaatatattcaattttcaaggtactaatttatcagcaaaagggcatggacctttagacactcaaatcataaaatagagcttgataattattaatattaggagatgcattatgaaatcttgtgtgattaatttttacaaatcaaataaaaattattataaggaagattatgaaagtgcttatatttgttcatatttaaaaacgtttggtgtttgtgacattatattgtatactcctttagagcatttaactttaactaaaatatatgatttattctttataaaactatatgatgctgagcagattaaacttttaaaatatattttgcaaaataactgcattgatatcaggcgtgtattcttctttggccaatttagtagaaataactacttattgttattaaaagacttttccaattgcaatggcgttattatcgaggatgagttcgatacaatttcaagtataatgcaaaatccacatcttcatgaaggtcttgcatacatgcatgatacggacatatgtaaacaccctaagcttagcaaacacattaatattgaacagattccaaaggcggacagaactattgcaaagaaaatcaaccaaaactatgctgaggttatattttctcgaggttgtaaaaagaaatgctctttttgtacaatagcttctagtaatttttatgattgtaaatctaattatctaattattgatgaaataaaagaaattatcttgaccaccggcatacatgaaatagtattcaaagatctaagttttgatgacagaattagtaaatatggtagagatagcttagaagaattagggcaattaattattcaaaacaacctaaatatcaagtataatgttaatttctgcattggtacattttcacataagaatccagagcatatttctcttttccaaatattgcgaaaaagtgggcttgttcgtatacttctgggtgtagaaagttttataaattccgatcttgttttatataataaaaaatatacagttgatgatattattgataccattgaattgtgccgccaaaattttatttaccctgtatgcagttttatatttataaatccttattctactttggaacagttaaagaataatttatgtgtttgccatcatttaggtttattagattttttgccagcttcgttgaatactctcaggccagaaaaagaatcctttttatataaaaaactcttagaagataaattaattgttcttaaagaaaacatggaaattttatggcaagatcaagatatatgcattatatccaaactatttcaatgcatttataatgataaaaaaatatggagaacttatatatggatttctaagttacatgatttagcatatgaattagagtatcttggcgtacgtagtgaggctaaaccaattctagcgaatatctataaattatttaatgatttcaatgatattaactataattatttactttcattaattaatactgtttcaactaattctaacattaatgatctaaaacatgcttttgatacttttttagattttatttcaaacaagtatattcatgaatttaaagcattatatagaaatataagaaaagaaatagaaataatgaaaaaactacagtcagtatttaatgtcaataatgaggtaatatagttcaggattatggaatataaagcatatcataagtgctttataaataaatattataaggaggtgagttatatgatacaagttaatttaacaccaaaagaattgcaggaaattgaagattctattgatatgactgatattgacaaagaaatggaacatgtcaattataatcaggatccgaactaactaattagtataatccacattaaaatccttgttggtttgaaaggtatttgatgtggattatactattatagtatttcataacttactgtaagttaaatcattaaaggaataccgattgtgaatttacagaattaaagttttttataaaagttattatatataactcaactttcccaccagcatgactggtgccaatgcttgatttatcaaacaaaataaatgaataataagtctgtagcaaaggtctatctgtttacatgaaacttagaccccggaccgtttcttgcgggaagcggcctgtctacggcattgccaacacttacactcatcggcagcctgttttctcctggacaagacgggaagagcgagatttccagtcaatatctgaaagcctgaagtttacgatattgactcccctgaaccccattttcgtaccaagtccaatgaatgatgcatcgcgaagggacaatgcggacgcactattatccttatagcgttggagattctccttaatgtcctgggcattaaatttcttgacaatagcgggtgttacggcatcgaacgatttcagccccttcgtcagcagaaactgacaaaacctgatgaccgaactgctgcacatggaaacggtattgtgtttcttcccttcccgccgcttttgctccaggaaatgggtgactagagcacggcaccattcaggaagcagatccaacactgaagcgtgatgcttccgccatttatcaggattggcatggcctgtcatattgaaatcgtcatacaattcgagcagtctccttaccataaggagattcgacttcaaaagtctggtcccggtggcggacagccctgtagaagcaccggaccggctataatccattccgctcatatcgaggatgagtaacagaagtgtcaaggatgtcaccgccgtatccagtatgataagttaaataaagctaattcattattatatattgtcgatggtgttgaatacaaattatttacatttgataaaaacaaaaccgcttatggtgatatacaattaattgcacctgatgaagtcggcttatatgaagtaattgctttaaagattcttaatccttttgaaaaaatacaagttggaacttggtgcgatgtgaaaaccagtgtccgctttactttgaaagtaattgactaaattttataaataattcttatgagaaatacagtcaactgtctcaatgcgcataattatttctctatgctgtcattgcccccaagttatatatttcttctaaaatagtgaaggagctttaaatctgtcatataacagaattaaagctccttcactaatctatactaaaaatatctttacccaaatttcataaaaacattgcctgcccattaatcatcaagatccataaattcgaaatcatcttcgtcttctatctcaggataccgcactgccgggtccggcctggactgctgtggcctgtctggatgattgactttcggctgtgatgcgtttgattgtggtctgaccgcctgtcttgccgctggctgtggtcttcccggctgagatacatttgtctgcggtctgccttcctctcctgcattctgctgcggcctgcctgtctgtcctgcattcgcctgcggccttcctgcctgccccgcattcgcctgcggcgctcttcctgcctgccccgcattcgcctgcggcgctcttcctgcctgtgcagcgtttgcctgcggtctgcctgctgggctctcctgctgtggtctaacagcctgtcttggttcctgcggcacacgcggtgctgcattcgcctgcggtctgcccgttgtctgttctcttgcgtttctcagcggtccggctgtgtcccgctctacctcttccgccagatgggccgacagcttcttctccatatcatcgaggctgtcttccatctcgaaatcatcatcttccggttcttcctgtgccttcagaggcacttccccgtccccttcaaactcatcacggctgtagcggcgcacacggcctgcctggctctccggttctgtgaaaaagccttccggctcctcatctctgccgcgccgttcttcccggaaacctccgtcagaaccattgccgccccgttttaaaaggacgataatcacgatcagaaggataaatgccagcacacccacaccaattaagatataccgctgcaggttataatcgcggacgaggctattgtaatcctctttcatcttgttataggaatccatggaaacgccggaagcgtaataccgctggatcgtcttttccgttaaatcataccggtagaagttcttctctccgttccagttcatcgcatagaacagacagtactgcggatcgccttcagacttcggtacccagccggttacacggattccatcgatatcgatctggcgttcctcgaagccttccggaaccgttatacccgcatcaagcggcacgataacaatcgccttggagcttgtctccacagagacgaactgtgaccaggaatctgcttctgcgttatagatgtagaagccgccgtttccgcccgcatcctggagatacaggagagtcagatctttttcgagaccctttccggccataacttccgttcccttataatcataggtgctcgcttcaaagccttccggcagtgctgactcgtcgaaggaagccgccaccttatattccgtaccgttcaccgtcacagcggcatcaccaaattctgcggatacgtccgctccgctgcttccgcccggtgtcgtctcaccgccttccgccttcgtcactacgattgtgtagttcttaacggtctggccatcctctgccgtaacgttgaccacgacctgattctctccggcctttaagcccttgtcaccctgaagcgtcacactggcgcctgcattagccgccactgcgttcacgactaaatctgcggtgctgccatccacggaagccgtgtagctatccacctccggtgaaaattccggagtcagctcgcctggtgatatcttcagagacttgagcgcggcatccttggaggaggaggccggggaagtcaccttgacagtggaaccgccctgcttatccaccgttacgatctgggaatccgcatcgtaaatctcctgggacgtcacggaaatctgtgtgtttcccgccttcagagccttaaacttcaaagtaaagctaaagaatttctgatcggcagcgtccgtggtgtcctgaagcttcaacgctccggctcccccgttcgcgccgttgccgcttataaattccagtgcggccgaatcgtaggccagcatgacatccgccttgcccaacgcggaatcgctggtaatcttcatcgttaccgtcacttcgttgcccaccatgaccgatgggtcggaaaatgcaattcttgtattggcagcccaggagaccatctgtccgaatggtcccataactgccagcatgcagaccagcataaggccggccatcagtcgtttcagttttattttcatagaaatctccttacttacgtttagttagaaccatccggagcgattgagatattgcttccgcctggtgttcccgcactgccgccggaagacggatccgatacgcccggtccgctgcttacgccagggccgacttctccgccgcccgggcctgccgatgaaccgctgcttccgccggtgcttcctccgacagaggaggaatacgtcggtccgttatcctgacgaaccacatgaaccacgtactctctgacactgccgttctgggccgttacggcgatccgcacatcattggcgccgctctgcagctggattgttccggaaccattcacggttgcctttccatcgatggcactggcattgaccgtaatactggaaacggaaggatcgacaattaagttgtactccagagtatctctgttgtaggttggcgtcataacaaatccatccacgcttaaattcgacagcttgttattcggattgccgtctgtagtcggctggctgcacgcgttatccggcatgttgttatagaccggtatcttaaactccagcgcagtctgcttcatctcgtcgttatatgccttcgcatagaccgccccctccgaagccgcgccctgtatattcgtcatatactggtgcttatagagattattcccctgtacgttgaatttcttcagataaaatgtatcctgtccaacttttacgtaattattaccataataaagagctccgcccaaaattgatttttcaggggaattccatggtctctcatagctgcctgactgagacgcccaccagagccctctctgtacggcagacatactgcctgactgatatgcctctatattaaagaaattataatagccttcatagcctgcttctgttccggtaatgctgccgccggttccgcttgaactctgttcctggataatcatagcagccaaaacgtagggattgactcccgactgggttccggcgttcataataatatccacatagttggtgctgccgctcggtgtcacagacccgctgctgctgttatctgccgaaggaccggtcagactgacgcccgggccgtattccatgagcacgcgcggcgtgttcggtgtgatggaagcgtgaggcgattcctggctgactcccggcgtactgcccttgctgggagcggcgctctcgactgtaccggagccgctggaaccagatgaagatcctcctgaaccagaagaagaccctccgttacttggaagattaacccccggccctccgccggaaacgccgggaccatacgaggaagaatcaccgccgcccgaactgccgctgccgcccggactgctgctgcctcccggagacgagctcccgccgcctgccgcggtaccggccagaaaggatccctttaccatggtctgaagtccttccaccgtgtggctgttgctgtcgtatgtatgggtaaggaactgaaaaacattcgtctcatccagaaaatttctcggatccatgtaatactttacaatatcctcggatgccgccacccaggagcttccatcgaaaccgggccatgtactgctgtcccagttaaatgcgccatccgcgatggatttccaggaagacatgctgtttgtgtgaaccaggttgcgtcctacctgactctcctctttaacagccgtgttccagtccaggttcgtatgctgagcccggaatacccacttcgggtactgcgcatgaagctcacgcagcctcaccttatagctctccgggaatctctccgagtttaaatacgcctcaaaatcggcgtcactcgtgtaggaaaccgggaattttaaataactctttgaaacatatccggtcgtctcagttcctcctgagcccttaacccggatctgataccataacgcgccgtctgaggccgtcttctcatctataaccgttactgccgccccgctggtcagcttcgtaacgatagaataggtcgtaccaggaccgctcctcacattcagcgaagaagcgttaaccgtcgccgacctctccatgtatgccatactctctatgtgcggtgaaacgtatcccacaagggaatcaatcaccaggacactggccagtaaagccgccattttacgagcttttttatatctcctcatctgtctctcccaacatgtcctcagtatttttccaattatactaatttatgtaaatttagcattcaatttattataatgacaaatactgccatgtgtcaacctcaacacgaaaagttcacacaattggcagtatttgtaagaaaatcttcaaacttccagcagacagaaaatggtcccggaagtctctcccggaaccatcgttcatttttatactattataccggataagccttgctccccttatccgccacagcagaatccacaccggtctgctgagccgctctgtactcgaagaattccttcgctacagccgggaacagcgcataggacagtacatcctcatcctgctgcttccactgcgcgcaatctttctcgaactgaggaagctgcggagcgatcaagtctgccggacggcaggtgatcggtgtctcgtcgccgatgatcttcttctgaacttctgcattgaacggttttaccgtctggccaaactcgcccataaggatcttcttggactcttttgttaccatcttgtaacgctcgccgctgatcacgtttaatacggcctgcgtacccacgatctgagaagacggggtaactaacggcggctcgccgaagtcttttcttactctcggaacttcttccagaacctgtctgtacttgtcttcctggcctgcttccttcagctggcttaccaggttggaaagcataccgccaggtacctggtactgtaaggtcttgatattgacaccaagaaccttcggatttaagcggccgctcttaagagcctcctcacggatcggctggaagtggtcagcgatctcagccagcaggttctgatcaaagcctgtgtcatacggtgttccgcggaaggtctcaaccataacctcggtagctggctggctggttcccagtgccagaggtgacattgcggtatcgatgatatcgcagcctgcttctactgcctttaagtaggtcatggaagcaacacctgaggtgtagtgggtatgaagatcgatcggaagcgcggtggattcctttaacgcgcgtaccagctcgtctgccttataaggtgtcagaaggcctgccatatccttgatacagatggaatcggcacccatgtcctcaattctcttggcaatatctttccagtaatccagtgtataagcatcgcccagagtgtagcaaagtgcaacctgtgcatggcccttttctttgttgcaggcttttacagctgtctgtaagttacggatatcattcagacagtcgaaaatacggataatatcaataccgtttgataaagacttctgaacgaagtactctaccacgtcgtcagcgtaatgattgtagcctaaaatgttctgtccacggaacagcatctgcagctttgtgttcttaaagccgtctctcagcttgcgaagtctgatccacggatcttcctttaagaaacgaaggcatgagtcaaatgtggcgccgccccagcactccacagcgtaatagccgaccttgtccatcttatcgacaatcggaagcatctgctcggttgtcattctcgtagcaagcaaagactggtgagcgtcacgaaggacagtctctacaatcttaactggctttttctctatttctgccattattttacctcctaataatctttattatttcactccgaagatagccatgaaggtaccggccgcaactgcggtaccgataacgcctgccacgttcgggcccatcgcatgcatcagcaggaagttggtaggatctgcctcagcaccgaccttctgggatacacgtgccgccattggaactgcggatacaccggcagaaccgatcagcggatttacttttccgtgagtcagcgcgcacatcagctttccgaacagcactccggctgccgtaccaacgataaatgctaccagaccaaggaatacgatctttaatgtgttccagttcaagaatgcttctgcactcgtggttgcgcctacggaagttcccagcaggataactacgatgtacatcaacgcgttgcttgctgtctctgccagctgcttcacaacgccgctctctctgaataagttacctaacatcagcataccaacgagtggcgctgtggtcgggaggatcatacaaacgacaacggttacgatgatcgggaataagattctctcaagcttggatacaggacgtaactgctccatcttgatcttacgttccttctcggtagtaagcagtttcataaccggtggctggatgatcggaacgagggccatgtaggagtaagccgccacggcgatcggtcccattaaagccgtctgtcccagcttgctcgcaaggaagatggaagtagggccgtcagcaccaccaataatggagatagcagctgccgcttttccgttgaatcctaagaggatcgccaggaaataggcgctgtagataccaaactgtgcagccgcaccgagtaagaagctcttcggattggcaattaacggagcgaaatccgtcatcgcgccgacgcccatgaagataagcggaggcaggatgctccattcgtccagtttaaagaagtactgcagaagtccgccgccggaaccatctgcaccaatttccttcataatatccggatagatattaacaagcagcataccgaatgaaataggaatcaacagtaacggttcaaatccatgtctgatcgcaagatataagaatacgaacgcgaccagaatcatgagcagattgccgcctgtcagattaaagaatgctgtttgatgaagaagattgttcaatgtgctaaatatatccatgttaatccctccatatggaatccgcctctatctggcggaagctctgccttagtttaatgtagccagtgttgcgcctgcttctacggaatcgccggttgctacattaatgcttgcaattgttccatcctgaggagctacgatttcattttccatcttcatggcttcaagaataacgattacgtcgcccttcttcactgcctgtccaggatttgccttaacgcctaaaatcttgcctggcattggagccgctaccgttacggatccggctgctccggccggtgctgctgccttcggtgctgcaggagctgccttcggtgctgccgccggcgctgcctttggtgccgctgctggtgctgcgcttccggttccttcttctacggttacgtcataaacattaccattaactgtaattgtataattcttcatgatgataatcctcctgattattatgcttttttccatttccctgccggtgcacgtctgatggagcgtacgacaagaccgcttgggctcgttcctgtagatgctgcaatcgcagctgtaatgactgctaccagttccagatcatcggccaggttctcttctgctgcctggacaactgctgccggtgccggttctgctgccgctaatggttccggatcttctttctttcccttgttcttcatcttctcttcaaaacggttaatatatttgaagcagccgatgaggaagctgatgaagatcaggacaataaatacggttcccatacccataaccatattcatggcggcctgttccatgttctcgcctaacgtatactccgggacaaaggaaacgctggtaatcgcaccttccctgtcggtcgtgataccgaagtccatctctctcttctcaaaaaccgcatgaaccgttgcgctgtagccgctgtcaatctcttctacctcagccgtgtcctctacggaaatcatggcgccaaggtcatgcttgacgttcttccaggagtccacaccctcggcaagagcttcgctctgttttgcagtctggcttctcacctcgtccagctgatcatccggaatgttcacgtaagagcttaaatatccggaagccatctggcttaactgagcctgaatgttgacatcgatctctgaggatgcggtgtcagccttactgcaggcagataatgaaaagagacaggctgccatgcaaagtcctaatgctactcgtttcatattcagtttcatatacctgtcacctcattctagaccgtgccatgttttttatccggacgatcctctctcttcgtgaataacatctcaaatgcagcaatcacgcgggctcttgtctcgcttgcatcgatgatatcatcaacatagcctctctttgcagcggccagtgcgctggactgtaaagtctgatagccttccgccttctcattgattaaggaaacgctgtcgtccgccttgccgatctcatccgcatacatgatcttcgctgcttccttcgcatccatcatgccgatggaagcgtccggccatgcgtaaaccatatctgcgccgattgacttgctgttcatcgttaaataagcggttccgaacgcctgtccgatgacaaccgttaccttcggaactgttgcattggcaaatgcatacgtcagcttggccgccgctttggcgatctttctctctgtgcatttgctggctttatagccctttacattgacaagcgtaagcaccgggatattaaatgcatcgcagaactccacgaattccgcagccttggtgcagccctgagaggttaaaaccgcatcgtactcagcagtctttaagccgctctcatcataggattctgtgcggttggcaacagcgcccaccgtcgttccgttcatacggatgaatccggttaccatggaaggagcgtaatccttcttcacttccatgaagaaattatcatcagaaatctgtgtcagcgcgatagccgtgtctcctacatagtttgcaaggtcggagcacacacgatttaaatcgtcgttacactcgtcgtaggacatgtcatcttcgttattggccgggaggatggtaaccagggttctgataccgcttaaaatctccgcctcatcgcctgtaaaatctgccagtccggtttccttactctggaaatcagcggatgccgtgtcgcatttgccggtatagttgccagccagtgcgttcggggaattcacaaataactttccgttcttgctttccacaaatgtgaaatcagccatagctgtggaaaccgccataccgccgccgcaggttccaaacactgcgctgatctgcggaatcacaccggaagccatggtctggcttaaataaagctggccaaatccgtccagggcatcggtagcttcctgaagtcttaagcctgcgcagtcgatcaggccaatgaccggagcgcccgtcttcatggccgccgcataaagattaacgattttttttgcatgcatttcgccgatggaaccacccagtacggatgcgtcctggctgtacacatacacaaggcatccttcgatggtaccgtaaccggtaacaacaccgtcagcaggggtttcccttgatgtcatgttgaagtctgtgtttctggccgtgatataggcgccgacttcaacaaaactgttctcatcaagcaaagcattgattctgttgcttgctgatgtctgtgctgaattactcattttgcaatcctccattttgtaatatttgtacgggctctgttaagtaattaacaaagatccgtagaataacaccaatttctgccgattataattgtataattaattatgacaaatttcaaggtttttttggaaaaaaaagaactgcattctatggatttttcataatccacatcatgcagtcctaataacttgtcagcattttttcacaatctttcttaacttccagcgaaatacacaagttttcgttgtctaatttgtaactattgcacacgtcattcccgaatgtccattatgcgaaatgtaccatcctctgtctttttatagcggatatggggattttcctctcccatggtcacgccatccgcgttcgcttccagtgtcgccgtgtcaactcctgcgatcgccaccatcaaatcgtccccgaagatcagatccggattctgttttaagaactcgtttctgtctgcaaaagtcatcttctctccatcagcagtctccagatttaaggggaatgcggccagatccgccagagcctccatgtccctgtccgctaccgcttcctggaccagctccgcaaatgcctcgatatccttatctcctgcctccgattctgccgcgccgcagtcctctgctcccggaccagctgccgcccgggcctctttctccataccttccggagtcgtctcttcctctttttctatctctgcgcgaaacggcgcagcctcatccttcgcggcctctgtggctgtcgccgctgtcgtctctgcggctcccgctgcctgagacgcgcttttccctgaacagccgccagccgccagcactgtgatgacagccagcagaacggccagaagctttcctcttctcaccataagtgcacacttcctttctgcgcttcgggcaaagtatataccacgcagaagcggaagtcaatagagtttccaaaactgtaaatgttagtcagttttctgtaagattcttcccttatttatactccttgtgaagggtaaatccacggccgcgcacctcgctgacctggttgataatcataaatgcattggagtccagccccatgacgagttcgttcagcttcgacagctcccggcccgatacgaccgtgagcaccgcataggatgcctttctcaaatggcctccctcgatcaggagcagcgtcgttccccggtccatccggttctggatcgcctcgctgatgatctcacactgctcgctgatgattttgacctgcatctggttctgtccgatcatcagcaccttatccagcaccatggtgtagagaagcaccagcagaattccgtacaggatcttctccttgcccgcaaacaccatctgggtcagcaggatcaggcagtcgaacaccgacatcgtcatggagaccggaaggcggaacttcttattgagaatcagcggcggtatatccatgcctccggtcgatgcccccgcacgtatcaccatgccgattcccgcgccgatcaggagtccggcaaaaacggtcgccagcatcgtatccccggtgaggggagaggaaccgaacagtccttcaaagacgccgagtataaacggatagtaaaaagtactgataattgtcgtaaatgcgaacgctttgccgagaaccgccgcccccgccacaaacatcaccacattaaaaacgccgacgaacgccgcgatgggaatcccgagcttatactgagccaccaatgccagtcccgtcgtcccaccggtgatgaggccgtttggaaggataaagagggacacggccagggcgtagagcgtatttcccgccagcacggttattatttttttcatattcatacagatctgacttcctttcatcggtaaataacaccgcctcccagtatagcataatccccggtttcttaaaacccccgccgttaagatttcgtttcaattcctctccgtcttactttttccgccgtcctcctgttatactttatgatgaaattttatactcagaaaggagtgaacacatggagttatatttaattatggctgcatttatctgcatcctgtgcatctttgcagggagcctgtcaacccgcatcggcgtcccctcccttctcctctttatcattctgggcatgatgttcgggacagacggaatcttccggattcccttttccaactatggactcgcggagagcatctgttccgtcgccctgattttcatcatgttttatggaggattctgtaccaactgggaggccgccaggcctgtggcaaaaaaggctgtgctgctttccagcgccggtgtcatacttactgcactcttaaccggccttttctgccattttattctgaagacttccctgctggaaggacttttaatcggctccgtactcggatccacggatgccgccagcgtattttccattctccgcatgaaaaagcttaaccttgtagacggcatggcgtccatcctcgaggtggagagcggaagcaacgatcccgtcgcctatatgctgactacaatcgtactgggcatgatggcgggccactcttccgccggctccgtcgccctcgtcttctcggcgcaggtgctgtacggtatcctgttcggcgtggcagccggcctggccggatcgaagcttttaaactctgaacagtttttttccggagaaatgcttccgattctcaccatggcccttgcagtcttaacctacggtctctcagcctcagtctccggcaatggcttcttaagcgtctatatcgccggtattatcctgggcaacagcaagataaaaggaaaagtggaactcgtccacttttttgacggcatcaccggaatgatgcagattattctgttttttctgctggggctcctgtgttttccttccaggatcattcccgtactggtcccttccgtctgcattatggccttcatgcttctgatcgcgcggcccgcggccgtctacatcatactgcggccctttaaagtacccttccgccagcagctgctgatctcctgggccggcctgcggggagccgcctccatcgtctttgccatcaccacggtcctgagtccggccgccatggaatacgacatctttcatatcgtgttctgcgtctgcctcctgtcggtggccattcagggctctctgcttccatggatggcgaagaagctggaagtaatcggttccaccgacgatatcttcaagacctttaacgactatcaggaagaccagtccatccatctgaccgaggtccgtctccccgagggacatccctggatcggccataccttccaggatatctccatccccgaggatatgctggccgtcatggtgcttcgggatgggaagacgctgattcccaacggtagcacgctcatcacggcggatgacaccatcatcctgaacagtccggcctatgcggacaaaagcggcatgaagctccgcgaagtccggatcggccggtaccatccatgggtgaacaaaccgctgtcggagcttacgcttcccgcagacaccctgatctttctcatacgcagggcgggccgctccctcgttccgacgggccagacccacgtccgcgacggagatgtcctgattttgaacgcgcagccggtaacgcacacggcggcggcttccgctttcttataaaatccgctttcttatgaaataagaaattttcgtttcagttccgcctgcttccgttcatttatgccgatccgttcattcagataggcttccacggaaccgcaggcggtctccatggcggaaaacgcatggcggatataatcctccgataccgtcaaaagcaccttcacgcactctgcaagcctcacgtccttcgtcttttcccgcaccatgtccgcggtcttcaccgcattttccatcacgtaatcattcgtccggacaaaatcccggataatcgtatccctgtctacggaaagggcggacagcagaagggctgttcccacgcccacccggtcctttccagcggtacagtgccagagcaccgcacggtcgtctgcctccagaaggatatcgaaaaagcggctgtaatacgccgccgcatgttcatccatgacgagattctcatacagcttatccacatagagctccggattcccgcccagggaagaggcgtgttccagcattccgattaaagcatcctgcttcggctttccctcctcctcgtcctcaaaggtgatccccaccgtctcctcgttcagaatcggattgaaaatgttgatgacgccgtctatctccgggtccggcttctggcttctctccacggaggttctgaaatccaccaccgtccccagacggcactcccctgtcagacgcgttatgtccgccggcgtagcctcatagagcgctccgctccgaatcagccgtgccggtacaatctgctttccatccatggtatgtatgccgccaagatctctcgtattgggcagcccctccagagggattctgcctgtgtaatgttttgccgttccgtttaaattctcttccattctgtacgcctctttctttcgttcattctttctcaatgctcatagtatatcacaaacgccccattcctaaaagcccctgcttagtccatcacgccccggcagttcatttgttgctgttcactctgcaatgccatttacaaatgaaaatggtgaccggaagagctggatcacacggtcgatgcaccaccggaaggtaattttctccacatcctcggtgagatagacaggaaatgtctttacggtctctccctgcaggcggtacgtcaccgttcccacggtctgccccttcctaagcggcgcctttaagcggtccggaagctcctcggatacggtcacttcctcgtcctctgccatgagaagctttaagctcttctcctcatccttcagatttaaatcggcgtgaaccaccaccggatcgcccaggtttccggaaagggggactccgttttccaccggaatttcaggtaatgtcttttcctggtagacctcccggtactgatagtgttcctttccatacccgaacagcttcctggcatccgaccatttatacgtcttgtgaggcggccatccacagcccaggagcgcgatggtaaactcccgctctccgtcctctaacgcccccacataggagtagcccgctccgcccgtaaatccggtcttgccggagaatacgccgctcatcatggtcagcagtgcattgtggttctggcagctgtaggaccgttttccatcctgatccgtaaaataatagctctgtgtccccgtaatcttcagaaattcatccttcttcggcgacgtgccgatacagtaattcatgatgcgggccaaatccgcagcggtcgtggagtgctccttcatctggccattctcctccttgctggcgtccagcccgttgggtgtgatgaaatacgtgtcgccgcaccctaaatccctggccttctgattcatcaggaccgcaaagccctccacacttccgcccacatgctccgcgatcatcacggccgcgtcgttgtgggattccagcatcaggctgtagagtaaatcctccagccggaaggtctgccccttatacacgcccaaatgaaccttcggctgggccgctgcattctgggacgccgtcacagtgtcggagagatttccatactccagggctatgatgcaggtcatgatcttcgtcgtactcgccatgggacgggccactccttcatttttcccatacaggattctgcctgttttcgcatccatcagaacagccgactgcgcatacagccccagttcatccttctgattttgttgttcctgcccgtccgtctccgcctgcgccgtaaccctgccgcatattcccgtgcacagcacaaggcacagaataaatagtatgacctgcttcatcctcataccaccctgtatgattttattttatcctattccttctatttttcatttattccggttaagaggtctggcctttaagtttcctctttacttacgaacatatattcgatataatagaagcagatcatttcttcatttacacagggagggaatcttatggcacagagtccgcttgtctttcatattgatgttaattccgcatttttaagctgggagtctgtctgccgtctgacggaggatccggaggcgctggatctccgcacgattccctccgcggtaggaggggacgccgcttcccgtcacggcatcgtgctggccaagtccacaccggcgaaaaagtatggggtcacgaccggggagccgctggttcaggcgcttcgaaagtgcccggggctgtgtgtcgtcccctcgcggttcgatgtctatattcattattccactctcctgatgaacctcttatccgactacacccctgatattgaaaaattcagcatcgacgaagcctttttagacatgacctccaccatccatctcttcggggatccgtggaccacggccaatcagatccgtgaacgcatctgccgggagctgggttttaccgtgaatatcgggattgcccccaacaagcttctggccaagatggcctccgatttcaggaagcccgacatgtgccacaccctctttctcgatgagatcccggagaagatgtggccgcttcccatccgggagctgtttttcgtgggccgttccgcacagaataagctggagggaatcggaatccacaccatcggccagctggccgcctgcaatgtggaactgttaaaacccattctgggcgaaaagtatgccatacagattcacgactatgcctgcggcatcgacccttcccccgtggcggaacgcgagcccatcaacaagggctacggcaacagcaccacgctgtcccgcgatgtggatgacctcgatacggcgttcaccgtgctgctgtccctctgtgagactgtaggagcgcggctccgcgcagatcacgtgatctgtgactgtgtctgtgtggaaatcaaggactgggactttcacgtacaatcccaccagacgacgcttaacagccccacggattccaccacggtgctatacgagaacgcctgccgtctgctgaaggagttctgggaccgcacgccgctccgcttgatcggagtgcgcgcaacgaagatatctgacgatgagttcagccagatcagcctgttcgaatcggagcagtccaagaagatgaaggagatggaaaaggcggttgaccagatccgcagcaaattcggcaccgacatcatcaaacgggccagcttcttaaagaaggactccatcgtcgatcacgccgccagcaagcaaaagcatctctcccattccgccttaaaggaagacgaaaaaggttcagagggcggcggatcaggcaaagtacgggataataaaagaggatggaatgaaacgtattgataacaatgctgataagatagaatttgagcgggaatacgattgcttcccgctcttactgtcatatgatctcgattggcttaaagccctctccaaacacctcattcgaatctgtgataatgataaacgcgcccttatcgatctcatggacctcgcgtctgatggggattacctggctgttattgcatgcacacatgacgaccttcttctcgtccagggagtaggagccctgtccttccagaaacgtacagccccgccctgtggcctcctcgatggcggctgccaccgccgcctcgcacgacgtaacgataagcatcagctttccggcgccgagaccgtacatgatcttgtcgatgaccatggtggtcacgatagaggagatcatacccaggatcaccgcgtccagattgcggaacacgaagccgccggccatgatgactacggcatccaccaccagagagatctggccgatcgtcaggtggggaaacagcttcctgatagccatgaccaggaagtccgtgccgcctgtggaaccgccccgcaggtaaacaatcgtaagtcccagtcccgaaaagataccggtacagatcgatgcatagaacgggtttccgtcatagacaggaatgatgggcatcacatagtccagcacaaacgcgaatatcaccatactcttcatggagcggagcaggaaccgtcttcccagcagcttatagctgacaagcaggatcggtatgttgagcaggatgctcacgatacccatgggaagtccgaataagtagcgcaaaataagggcgataccggagacgccgacaggggcgaactccgcgttcaccgcgaaattatagatcccgatattgaaaaggaatgcgcccgcgatatcgcagagcaggtcgattcccaggtcttttactgtatactgctgtctgattccagtcatttgattctttcctccatttcatctccgtgcagctgatacggcctgtctctagaggaaataatcgtcgatcttaaactcctttttccctacacggatccatttgatcagcacgctggtctctccgtcttcctccgcgcagactccgcagccgtgaacctccgtccttccataggattgcttaaagatgacttctttatccataattccgcgttctgctatattttccgccagatcgaggagcacatcctccacatcttcctctacatgattcttctctaattcctgttccagtgcctcataaagctcttcgttcatcataatcgtatgtcctttcttattttccataagacaattatacatttttaaaatttcttgtcaatctcacccagccatgataaaatttatgccatgaaaacgactatgacatacctcattcaacaacaggacatacaaaagaccgtagaacagtttctgctgtcaaacggctattccgcagctctgatccgccggctgcgccacacggagcaatccattttaaagaatggaagccctgtctatacgacgtacaggctggacgagggcgactccctcaccgtcacactgcccgaagaacacggttcagaaaatattgttcccgttcccatggacctggacatccggtacgaggaccgtgaccttctcgtcgtcaataaggccgccggcgtccccattcatccgtcccagggaaatcacgataatacactggctaacggaatcgcctggtatctgagggagaagggagaggtcgctacctaccgggccattaaccgcctggaccgtgataccaccggcctgctgatactggcgcgacacgcactcagcgcctgcatgctgtccgagatggtccgtacccatgccatacgcagatgttatctggctgcggcctccggtctggttcccccggaaggcgtgatcgacgcccccatcgccaggacctgcgattccaccatcgagcgctgtgtggactttgaacgcggagattctgccagaacccattaccgcacgctgtgttacaatcgtgacaccgactgttccttagtggagctgcgcctggagacgggacgaacccatcagatccgggttcatatgaagcatatcggccatccgctgcccggcgattttctctacaatcccgactaccgcctgatcggcaggcaggccctccattcctggcagctggattttattcaccccatcaaaaaggagccccttcatttcgaggcccctcttccagaggatatgcgccggctcttcggtcaggagacgaataccgtccctcccatccagcgcagtcccttcggataatgattttttaagattccaccggccagtttggaaaatcccagggaccagccatccacggtcatcaggacccagcccttctgtccgtttaaatcacagttttttgcttcctcgatcctcagcgtttcccccttcagataacggacagcctccatcccatccgccttcatggagaaacggcgcaccgcctcctcttccttcatggagagcgccagggcgtgggatggctcaaagcggttcttcttcatcgttcccatatgaaggccgggacgcaccacctttaggccggccagatcgatcatctgaggcggaagcagatacagctggtccccgaacaggatatactcttccctgtccaggtatcgctccggttccgtaaacagctccctgcagaagccttcatactccttccacacggccttgtctttcaaatacttcggaccctttcgtttccacgtcccgtcgtcctcccccgtcttgcgaagcacggccagatagtggccttccccctccgataaatggggccatatccggtaggttttccggagtgtttccatggacagggttccccattccggcctccccggtgaaaggccttcccgggttcccatatcctcgatctcaaattccggatgatccgaaagaaacgtctcgatggtctgctcgtcctcctccggggaaaaggtgcaggtggaatagaccatgcgtcctccggccttcagcatctgcgctgcatgatccagaatctggcgctgcctcgccgcgcacataaccacgtgatccgggctccactggctgcgggcttcctcgtccttacggaacatgccttcgccggagcatggagcgtccaccacgattttatcgaaaaactgagggaagcgctctgccagccgttccggcgtctcattggccaccaccgcgttccggattcccatgcgttccacattctgcgagaggatcttcgccctggccggatggatctcattgctcagcaaaaagccttctcccagcaggtgtccggcgatctgagttgtcttgccgcccggcgccgcgcagaggtccagcacacagtctcccggtttcggctccaaaagttccaccactgccatagcgctgggctcctgaatgtaatacagccccgcttcatggtacggatgctttcccggccggtccctcgaatcgtagtaatagccttccctcgcccacggaatctttgtcaggtgaaacggggccttcgctaaatactccttcgcctccgcctttccgggattcagccgcagtccctgcacccgctccttttcgtagctttccagaaacgcctcatattccgtttcaagaaggcccatcatcttttttttaaatgcctccggcagctctatcatcacaactcctcatttttctcaagaattctttccaccagattaccagattcggccttttccgtcaatgttccggaataattttcctttatttttccaattttttcgacaaattacacactttgtttataaatattttcgaactatatgataaaaatatataggagacgttaaaacgattcttcaactaatgaacctgcgaggtacgacatgatattaaacatcaccgcttactttattattcccgtttacacgtttctttttgcctggggaaccgatttattcaggctgaacttctccgtactgggcagtctggccaaccgcaagaatgcctttctcttatggggaatcatcgtgggcatctatttttactatgtgctgagaaaaattattcatcacctcccacgcaaccggaaggagacggttacgagcgtcagcgctctgatcctgctggccttcgcggtcaccacgccctatcttcccgaaaacaggccctttcgggcatttctccacgtgatcttcgccttcagcgcctccgtgctgctgctggcctgtctctacctgatcgtgtggaagctctactgcatgaaccaggaagtataccgtccctacttcatctgtctgaacatcatcactgtgctgtcggccatgctcttgtgtctggccggaatcgtcagcagcgcgctggaaatattctttaccgtatcctgtactctgatgctcatcagactgtaccgtcgtgttacatcatccagggacggttactacagtctgaagcacaaagtctaaaaacgccgcaggccgcccgcaggtacgccatctgactcgctgccggcagaaaaatagtgctgtaaaaagaacatcatccgcaaaaaacgcgtccattccttttacagcaccgtatcgtgttctatgtattcaattataacataaccttatactggtcagaaccttcgccgtttacaacgtagtaagcagcatgctcttccggcttcacataaatctcgattgtctcgatgacagcgcccttgttcatggactcataagccttctttgcagcttccagaacatcttttgcagcgatctgctttccagcaaactcgattactacggaagattttacttccttcccggctgcaggcttcttagcaacagctttctttggcgcagcttcctttttctcaggtgcagccttcggcgcagcttccttcttagccggagcagccttctttggtgcagccgctttcttctcagccgccggttttgctgccggtgccttcttagcctcggacggagctgctttcgccggcttcttttctaccgtcttgacttctgctgttttcgtctctacagctttcgtctctgccgtcttcgttgctgccttagtttcactcttagtattcatcataattctcctcctcaaacagattcatctgtttctactgttgacgtgtataagttcagcctgccttctgatgtttatattttagctgagtgaattataaaacgaaaatatcgttttgtcaacaaaatgactcgcattaaccctgcttttttacttatttatgcaggattttagaggaaaattacataaattttgcattttacaggtattttaaaatctgtgaataggcagccctcagttcttcgtaactggtccggcagttggctgggctggtcgacggaagccggatggaggcaatctccgtctgggaaaagcagtatctttcatacaattcgtccgcttttgtccctgtcgtaaacacggcccttatgtctgcccgggaaaggatcacgttcatgtcgttgggtaccggatttttaatggagctgtcgtccgctccgcagatatcgcatcctgcaaggacgtcccacacggcgatccggcggcgcagtgccaggctcttcttctcctcaatcgtcccaggcgccggttcccctaaaatatccgccaggaccggccagaaacgattgcgcggatgaccgtagtagaagccctgctccctggatttcggagacggcatggtgcccagtatgagaactctagagttttcgtcgtataccggctggaaggtatgaacgaccgtttcctctctgtttttcttctgcattatggccggatcacggagctggcccctgacagcttctcggcgatatcgtacatgttggtgacattgccaaccgccagcttctcggaaaggccgtaaaagttcaggcatgtgccgcaggtaaggatctcgactccctgcgcctccagactccttaaatcttccacagactgcgatccctccgccgacagctttgcaccgccgttatagagcaggaccgtatcaggcagcacgtccagctgggtctgcgcatagagaaagcccttcatcagctgccttcccagctcatcatccccgcttcccatacagtcggaggaaatcaccacgacctggcccttcctcctggcatccggaatacaggcttccgccttcacgtctgcttctgcagcctcattggctgtatttccctctttctgaggatctgccgctttccgttctgcgacatcgtagctcacccggaattcttcctctgttagcttttccgataccggcttcagtccaaaatagccgcccagcttcattaagttctgtacggcgatctcattgtccaccaaaacctcgacggttccctccgtcatctctttcagtacctctttcgccttaatcacaggctgggggcagggaagtccctttgcatcaacgattttcttcatcttatctcctttccggccgtctggtgcctcccggcgtaaatacgtcgggaggcaccagcacagctttgcattaattcagtataaaatatcacatataacgccgttaaaaaagaagagctatcatccgaagacaatagctcagcctctttattcgttttcttctgtctcgtcttcgcctaccagttcatcgtactccgcatcatccagcaattcgtcaaatgcatcggctacgatctcatattcatcatcatcttcgatattctccagattcggctgtccatcctctgactcggaataacggtataagtaaacctctccctcttccgcctcagcaccttccatcggaagcagagcaatgtaatcacgttcgcccgccgtaaaaatggtgagaaccacacactcgatttctgtaccatcgtccagagtcagtgtaacggtcatttcctcctgctcttccatgttctcctggtctaaattcggatcctgtgccatgtcgatacctctctttttgtaatgttcttttctattattttgacgactatttcgtctctttccactctatcagacaatggtataaaaatcaagggatttctgtctgatccggaataaacttgactgtataagtcaccgtttactgcatacttaatactcaattccctctcgcgcctggatcccctggtcgtaaggatgcttgatcttttggatctctgacacgtaatccgccagggaaatcagttcctccgacggcccgcgcccggtcatcacgacctccaggccggagggacgtccggttataaaatctctcaccgtctcttcccgcaccagaccataattcatgactgccatgatctcgtcgagaaccagcagatcgaaggcgccatccaccgcttttctaagcgtcatatctaacagctccgtgtaatacaccgccgcctccttcttctgttcgtctgtcatacggaagaaaaatccgaagctcttctcacacggtgtgaccgagattccaggtatcagcctcagcgccgccacctcaccggaatggtcggtctttaaaaaccgggtaagcagtacctttctgccgcatccggccgcgcggacggccagtccgacggcggccgtcgtctttccctttccctcgccgcaatagatgtgtacacacgaatccatgttatgctcctttctactcccgtcccagatactcctttacaaaccgggacacctcctgtttcttactgtaccgctcgctcacgtaattgacgtggagccgctccttcgccctcgtcatggcgacgtagaacatgcggcgttcctcttccatatccgcgtccagaaccgccttgtggtgcggtgtaacgccttcgttggcatcgagaatgtaaacgatccggtactccagccccttggagctgtgcatcgtcatgagggaaacgccctccgtccgcttctccctggatcgggcctgaagcttcagttctctggcatactcctccatatgggcgaaccacgcctccaccgtctgaaatcccgcggcgctctccgccagctggtccagaacctcgaacagctcctccggcttcatacggcggtactcggcgtactctctgatgtaatcgtcatatcccaccgctttgcgtatgtaattcaccgcggcggcaggcgccagctgcctcaggaatttcagatcgtattccagctgttcgatccgctccaccatccagcccttgtcctgataaaaggacttgaccgcctcccagctcaccaccggcagttccagtgcgtcccggctgatgtaccggttcgggcggttgatcaccgacagaatgcaggcgcggcttaaatcaccggcagcagcatttaaataggcgatgatatttttcgcgatccagtggtcgtaaagattcggcacggcgtccttcatgcagaaggggatattgtattccatcagcttctcgatcagcagacgcggccccagattcgtccggtacaggactgcgatatcggaccaggcatatccggctccggtgtaatccgtgatctcgtggacgatctccagcgtctcctcctgcggatccttccagactctcgtaaccacaggctttcccctgccctgcttcgtgacgatctccttcggaaaacgcgttttattatgggcaatcagcttaccagccgtgtccacgatgtccttcgtactgcggaaattgatatttaagaggacccgctcggcatcgggatagtccttctcaaagcccagcataatctccggcttcgcgccgcggaaccggtagatggactgatcgtcgtctcccacaataaacaggttgttctcaggagccgccagcatccgcacgatctcatactgaacccggttgatgtcctgaaactcatctaccagtatgtactgatacttcctctgccatgcgccaaggatgtccttcctctccttaaacagatcgtagcacatgaccagcatatcatcaaaatcgattaaattcgctctcctcagccgctcctcgtagcccgaatacagcttcttgaatatctcttccgaacagttcttcgcatagtagtggttcaagtggatcatttccccttttacggagctgatctctgacaaaatggagctgacaaactccgcttcgtcctccacctcaacatggtttgtctcgatcagttccctgatgtactgcatccgctgttcatcacgcacaatgttgcgcgcgtcatacctgtatgcaaattttaagattcggaaaaatatggcatgaaatgtgccgaaactgacagatgacggtcccccgccgcacagactctcatatcgctctttcatctccgtggccgccgccttcgtaaaggtgatgaccaggatactggacggattcactctgcattcctccgttaaatacttaatccggtgggttatggtaaatgtctttcccgaacccggaccggccagcaccagcatgggacccttatcgtgagtcaccgccgccttctgtgcaccttcaaatattacttctgaactcatcggttttcccttctctcagagggaattagagcgcgtctgaaacgtctgatcagacacgctcaaaacccttatatcttctctttactgacggctcaacagctcgattcccgtctgaatccttgcaatggattcttccctgccgagcacttccataatctccgtagcgcctgccggtgtcatctgcttgccggaaaccgccgtacggatcggccacataacaaagccggtcttatagcccttttccgccacatacgctgacagcgccgcatataaggcgtcgttgctgaagtcctcctgtgcttccaggatcggcagaacttctgtgagaaccgtcaatgcggtctccttattcgtcttcatcttcttatgaacgtacatctccggatcgtactccggaagcgcctcaaagaagtcgatatggtctgcaatatccgggaaaatctcgattctcgtcttcaccatggcggcgatcttctctaaatcgagatccttcgtgatgaccttcctgatatgaggctccgccatctcaaagaaccggtcaaactccatggccttcatatattcgccgttcatccattttaacttcgtcatatcgaatacggccggagacttactgatattatggtaatcgaattcctttattaactctgccagagagaaaatctcacggttgtccaccggagaccatcccagcagtgccacgtagttcactacagcctcggagatgaagccctgctcgatcagatcctcgtaggacgcatgtccgctcctcttgctcagcttcttatgctcttcgttcgtaatcagcgggcagtgcacgtataccggaacgtcccagccgaaagcagcgtagagacggttgtacttcggtgaggaggaaaggtattcattgccgcggaccacatgggtgattcccatcaaatggtcatcgactacattggcaaaattatacgttgggtatccatccgacttgatcagtaccatatcgtccagctcggagttgtccacggtgatgtcaccgtaaatctcatcgtggaacgtggtagttccctcggttggattattctggcggatgacgtaaggcatgccggctgccagattggcctccacttcttccctggataaggagaggcaatgcttgtcgtaggtcataatctcctggccttccaccgtctgctttaaagaatccagacgctcctgcgtacagaagcagtaatacgcctcgcccttttccaccagcagcttcgcatactccaggtaaataccggaagcctgacgctcgctctgaacgtaagggcccacgccgccatccttgtccgggccttcatcatgaaccagtccggtctcctcaagcgttctatagataatctcgacagcaccttccacataccgttcctggtccgtatcttcgatacggagaagaaactctccgtcttcatgctttgcaattaaaaatgcgtacaacgcggtccttaaattgccgacatgcatgcgtcccgtagggctcggtgcgtatctcgttcttactttgctcattttggcacactcctaaattattattttacgcgtaccctattatataacgaagtactggaaaaaacaatcatttcatcgaaatttggcaggaaatcaccggttcctccgccgtatatggaaccggcgggaatccgtaataatcctaagaataattatggctgtgaataaaaggatcgcagttgtacacagctcctggtaagccgtccccaactttttcttcccttacggaatcggcgggaacacagagataatccccagaataaccgctgcgataataataatcgccgccagacgcctgtcctttaaaatcagaggattcctccagccgttttcaccctcctcctcttccgagtctccgtcatcgtccaaatccccctccgcttccgaatcctcagcagccacataatcctcatcgacctccgcgtcctccttcatgcactcccactccttcagatatccctgggcagccaaaagatcggaggcgcgcacatagatcttttccccgaaaatcgagtagcccatgtagaccctcatatattcgccgctttcctcatccatggaatacgatggaattccatgattctccaatattccctgcagcagcttcgcctctatgtgatcgctgaccgtcgtcagcatctccacatcgacaccctcagacgcaaattccacattaccttttttcccctcctcttttttgacgagcggggtctggcagtccgtgcatacctctcttccatcgaaaaactccgcgccgcaattgggacacttcatcgtcatagcacatacctccctttccgggccactttcggcatacaggcggccattcttttcatccattataccataaaatccctgtgtgtaaaaactgtttacatttgtctccgcatcgtgtaaaatactttatatcctactaaacagataagaatgataggaaggagaacgacaccatgaaaatctctacaaagggacggtatgcccttcgtatgatgctggaattcgctctgcatccgggtgaatgtacgaaaatcaaccaggtggccgaacgccagcagatatcagacaaatacttggaacagattgtgacgattttaagccgcgccggctatgtcaagagcatgagaggcgcccagggcggctattatctgacgaaggagcctgccgattatacggttggcatgatcctgcgtctcaccgagggcagccttgcccctgtagcgtgtatggaggacgaattaaaccagtgtgtgcgttccggccactgcgctaccttaaccgtgtggaaacagctggatcaggcgattaacggggttgtggacagcattacgctcgccgatctggtggaagaacagaagaaactggatggtgacagtcatgattcatgaattctcacggagtgaactccttctgggaaaggactccatggaaaagctggcaggctcctgtgtcgccgtcttcggcgtcggcggagtgggatcccactgcatcgaggccctggccagaggaggcgtcggccgtctcgtcctgatcgacaacgacaccgtctcgatcaccaacatcaaccggcagagcatcgcttatcacagcaccgtcggcatgtacaagactcaggtcatgaagacgcggattctggacatgaatccacaggcggaagtctttgcatttgagacctttgtcctgcccgataacatagaaaatctgtttgaacagattccctgtaaagtcaactacattatagatgccatcgacaccgtcacagccaagctggccctggcccaatacgccattgaccacgaaatccctttcattgcctctatgggaaccggcaacaagcttcacccggaactgtttgagatcacggatttatcgaaaacatcggtctgtccgctctgcaaagtcatgcgccgggaattgaaaaaacggggcatcacttctctgaaagtcctgtactccagggaagaaccgctgaagccgctggaaaccagcacagaagtcacctcgaagcgctccgtgccaggcagcgtctctttcgttcccccagtcgcgggtctcctcatcgcaggggaagtgatacgcgggctgacagggaagaattagatgcaggacagtaaattctgctgcaaacaaatatgcaaaaccaaaaaaacggaagcatttaagggccgctcattatatcccggcctctcaaacgcttccatttcttatacatcttttatctactttatctacccgtgaagcctctgctcagcgccatatcgcctctctagaactttgcaatatacccctgaataaagattaccagcacgatcagaggcaggacaaatgtcacatatcctctcacccatctcgggaacttaattccctttccttcgttggcttccttcataaaattctcaaatccccagccgtatcttgtggtacagaaggccagatagatgagacttcccagcggaagcaggttgttgctgataatgaagtcctctaaatccaggacattgctgccttcgccgaatggcatgaagccgctccacagattgaatcccagcacacacggcagggaaagcaaaatcactgcagccgcattgcacagtacggcctttttgatggtgcagcccgtcaaatccgtggcaaatgacacgatattctggaacacggcgataaccgtggataccgccgcaaatgacataaacaggaagaacagcgatcccaccagtcttccgcccgccatattattaaatacattcggcagtgtcacaaagatcagcttcggtccctggccaggttcaatactgaacgcaaagcatgcagggaaaatgatcagtccggccataaaggctacgaaggtatcgagaatcgtaacggaaatcgcctcgcccatgaggctgcgctccttgccgatatagcttccgaaaatcgccagggcgccgattcccagactcagcgtaaagaacgcctgtcccatggctgcgaagattacttctcccagtccggcttcctgaatctttccgaagtcaggctttaaatagaattccagtcccggtccgctgttgtccatcatgaccgagtgtaccgccagaatcaccatcagaaccagcaggcagaccatcatcaccttggtgatcttttccacgccgccctgcagccccttcgcgcagaccgcgaagcctccgattaccacaagtatcataaatacagccatcagaaccggatttgccagcattccctcgaattgcgcgccgacaccagcagcatccagacccgtaaaatcaccttttgccatcttgaagaaatataagatcatccaacctgcgaccgtggtgtaaaacatcatcaggatgtaatttcctgccatgcccagatatttggcgtaatgccacttcgttccttttggctccagcacatcataggacagcgccacacttctctggcttgcccgtcccactgcaaattccatgactacgatcggaagacccagtatcactaagaataccgcgtaaattaatacgaatgccgcgccgccgtactggcctacgatgtatggaaaacgccatacattgccaagtccgattgcgcatcccgctgaaataagaataaagcccagccgggatgaaaatttttctctccccatactctttctctcctggttgtttaaattcgatccgccggatcagccaaaataagcttccttctgaccaaaacggcaaagattctgtaccattatagcacagaatctctgttgtggctacttcatattatactgtatacgataccgtttctaacgccggatggaagccgccatccggtggtacgtatggcgcactccgcggatcacctttccatattccaggatattttcaggcagtgccatgccgccgtatccggcgtctcccaggtgatgcatatccgttcccgtcatcttgcacatcagcgcaagctcccggatggtagccggatctgagccctcctgggaggttcctatcgccgtcagcgtcagagcccccagctcatgagcaaaggagaccagcccccggatatactccatggtaattcccgggaccgtccccggagccggcataagaatcacatcggctcccgcttcgcgaaacagcttcacatcctcccgcgtgatgatcttctctcccgcctcagagagaattcccgccgcgtgcatctttccggccaccaggacaatgctgtcaccgaattccttccggtaaaccgccagcgtctcctcgatggcccggttggtgacaccgacacccggattccctgtcagaacgatgaaatcgacacccatatcgaccgccttcctcgcattttccagcgttcccagacggccacccgtgattccccacatggagtccgcctccaccgagctttccacgccctgttcctttggctccaggttgatacccacaggacgcccggtcagctccttcaccttccggatcagattccctttgtcaacaggcggaagaccgttgattacagggtgatccacatcgaagatatttaacagaatcacatcggcgcccatggccgcggccagctccgcattgctcacatctcccagcatgggctgtaaatttccgatggtctcacagaccagcacccggccctcgctggaggcaatggattccaccagttcttttccgttcattttctcaaaatccgatgcattgcaatttaaaaaacgtttcactgctttttctcctttcccgttggaaatgattggttcccgtgtttcacctagtccttctgtttaaatgtcgttccgttaaaaatcagcatgtccttccccagaaacatgaaaactgcctcccccagacatatcatacccgtaaacagaaaaataaaatccatacatctccgccccctttatatttaatacttgatactattataaaggaagaatccccataatacaattattttgcatagcctgtttcatatactgcaacagccagccaactattcctaaaacgaaaaagagtccggcaagccggactctcgcgccggagcgcagccgcttcagcagtcatacttcattcattctctttattccatacgaactgcctggtccagctcaattcccgccaataatacaatcccaataccatgggtatcattcagcgtccatccaagcgtatcccggtagtaatcgccggagaaggagtagaaggagccgcggcagattccatatacattgccaaaacggtccagagctgtctgttttaagccttcccacgccttcatggccgatgccaggagttttttgcctaaagcgtcttcgatccagccaaatctgaccgcccggctgaagccgtatataaacatggcggtacaggaagcctcctcataggattccgggagcgtcagcacctgatgccacaatcctctgcttccctgcaaggccacgtatccctcacaaaggcttgtaaagaattccaggatactgcctctgtctttatggtcctgaggcagatattccaacagctccgatatggaaaacagcgcccatccattgcctcttccccacggtacctgtgtggccgcttccacatgaaaatcgtatacatggctcatgatcttatactccggcatatacagatatttcttaaacatcagcacctgattcgccgcgtcatccaggtactttgcgtctccggtcatctttgcgtaccggcataaaaacggaatactcatatagagatcatcggcccacatggtcgtatggccctctcccaggcggcagaaggccccatcttcccttcgggactgtccgctatggatatagctgccgatccggtcggctgtcattttgacattcccgtccattttgtctttgtaaaattccagcatggcagagccgaaggagccacaggtatccagcgagtccagaaccacaagctggttattgatctccgggtaaccatacgtctttgcatcccacagactgtattcatgcatggcagcacactcatggatatgttttcttacatattccgtaatgtccggcctgtctaatacccgggcggcctgggtcaggccgtagagcgttacacctaaaggataattccagcggccaaaacagggattctcgagataggggcgaaccaccgtatgttcagctgctttccagtagcatttctcagaatcgccgaacaagccgtaaaagcccggaagcttccagtcaggctttgcatcaaacagtcccaggtaaaggcagggccccttcactccatctgccccaggattcatgagcttcagctttgtacggtcttcatactctgctgaaaacctgacagtccagctgctctcctccggacagcgggaacaggccagcagatcgtggtttccagcagttactgtaatgtcaccggactcgatccgtcttccatccaaataaaattcagcgccggaacaggtaaaggcagccgtctgttttcccggcagattctgtcggattttactccatatacaggcccactttcctggccggcggccaaagacagcctccagatccccgggagattccattgtctcacgcgtctgagcaggataccagcaaagccctgtatccgcctcgtttccatttagatcaatgtccgggacattgactcttgggccgtcaaacggctggctgtataccaatccgccctgtccttctctttctgcaaaaggcgtcagaaacggaatccagctccagacggacagctccggttctaaatggcagccgaaaccggaggttcgtttacagcagcgaagcatcagcgaattccagccggcaccgcagggcaatacaacggaggtcaccttctgctcattattttcttcataaggagtggattcccacagcaggctgccattaaaatacacatctgcctgactgtaacaccgtatcaggagtgttctgttttcggaactactgctgtaaaacttagcggcaattaatgcatactgacccatcaaagcctccggcagcttagcattcaaatccagattatagcttccgtctgcatcaggaagaaaggaatcatcacgaaacgcccggaatcggaaagagccggccgggttctgtcctatgtacctccccgcaacggtactcaaaatatcatgaagcggcgcattgccagatttcatactgatattgctgtcaaaatacgtattaaatgtctccatcgctttccctctctccgaatactaatagattctctttgcaaaaacatcgtgaaggcgctctatggataccttcggttttctgtcctccgttaaaagcccgtttacctcctgcatgacatccgtcagctgggtatagcagaagccgttgaaatggccgctgcggattaagaattctgtaatcggctccaggattccaagaaactgttcctcatcctttactcttccgtaatacccccaggaaccttccgctccgtctccttcaaaagcaatgcctccgtactcggttaagataaccggctgtccctgatagctgtttccttctgcaaacaagcggcgggactcgcaatacgtctttaatacgttctccatatcatcatactttttctccgtttgcgggaaaagagcgtaatcgtgaagggcacagatatccgtgtcacttacctgctcccagccatcattggcgcttacgaggcggaccgggtccatggcttttaacaggtacgtcagcatacggcagtaattctgctgctgtaaattccctcttatggaccggactccccagctctcattgaccgggacccaggtcacgatacagggatggttatagtcacgtttaacaaattccatcaattccctggaagaggcttccatcgcattgtcattgaattcgtaggcgctcggcagctcgccccataccagaagccccatcttatccgcccagtaatagtatctcggatcttcgatcttctgatgttttctggcgccattaaagcccatcgcctttgtcagacggatatcctcctggatggccccgtcacttggcggcgtcagtatggattccggccagtagccctgatccagtaccagacgctggtaataagggctgccgtttaagctgatgattccattttcccattcaatacttctcattccgaagtacgctgccacctcgtcggcacacccatctttaccggttattttcacaattaaggtaatcagattcggctcttccggcgtccagagcagctctccccgccttatatcatagtccgggaatgccaggcttaacttgccgtagccatgacggcagggaatcatctgcctgcatagaaatacgttcccattctccagataagccgtaacctctgcttccacctcttcatcacaggagacaaacacttcacagagagccgtcaaatcgcttaactgcggtgttgccttcactctctttaaatagcatgctcctgcgtactccagccagacactctgccagataccggtaacaggggtataccagcagccgaatttctcgccggtccatgtctgttttcctctcggcttgtcactgtttgtatcatccacggcctttaccgttacttcattgcttccttcttttacaagttctgtaatgtcaagttcaaaagaagtataaccgcctgtatggccgcctgcatagacaccgttaatccatacggaggcctcggaatccactgcgccaaatttcagcagaagacgttttcctgttagcctttcagcttccacaaggaattcacggcggtaccataccacatcatggtcctccgtctctccaatggtgctcatggtggactgatagcagaatggaactgtaatactccggtcgaacaccggctgatcgaaggaaaactgccaggtcccatttaaaggactccactcatttctcacaaaatccggacgcggaaattccgggcgcaaaactgcattcatctctgtacccacgtttttatctcctctttgcatacttaattttcgttgcttttcactccgcagagcatacgcgctatccctttaagccctccgtgctgataccatttaccagatatttctgaaagaatacaaatataaggaaaatcgggataatagacagcgtagccatggcgaacatggcgccccagtcagtaattgaggtcgggtctgcaaacattttaagagccatcgttaccggatacatgctcggcttgtttaaatacagaagtgatcccatgaaatcatcccatttccacatgaaggagaagatagcgcaggtcacaagagccggcacgattaacggtatgataatgcggataaagatatccaggtagccgcatccgtcaattttagcagcctcatcgagatcctttggaattccatatataaactgaataatcagaaatataaagaaagatccgccaaaaaagctcggtacgatcaggggcaggaatgtgcctacccagcccaatttgttgaaaataatatactgcggaatcataataacctggaatggaagcatcatggtaacaagcatgcagataaaccagaaattacgtcccttaaacttcagtcttgcaaatccaaatgcaataaatgccgaggaaaagacagcgccgatggttcccactgcagcgataaagaaggaatttttaaaaaatgtggcaaagctgatctttgcaaatccgcgccagccgtttgcataattttcaaaatggaattcctttggaatcaggctgcttgcactgctgaatatctcattgttttctttcaaggagctcataaccatccacagcagcggatatatcatcgtaagtccgcctaaaataaccagaattgtggttatcacctgtccggcgctgactttttcctgtgttcttacggaactgttatgtttcatgcgcatcacccttccttcgattcattataaacccacctggttgacgactgaaagatcagagctgtcaggataccaattaccacgagcataaaccaggccatggcgctggcgtatcccatctcatgaaactcgaaggccctctgatactggtaaacacagtaaaaacgggttgaatccctggggccgccgccagtaatcacgaagctctgtgtaaaggccataaacgcattaatcgtctgctgcaccagattaaagaagagaaccggcgtcagcatgggaagcgtaatgcttataaactgtctgaacctggagccgccgtctacggtagctgcctcataaagactggccggaatctgttttaagcccgcaagaaagatcagcatggaagaaccgaactgccatacggcgaggataatcagggtccagatggctgtatcctttcttcccagccacgaggtatcgcccggcagccccaccagagccataagagcattgatgacaccgtcgctggcaaacagtcttctccataaaacggctacggcgatactcccgcccatgatggaaggcaggtagtagacccctctcataaagcctgtaaaacgagtattttttaagaacagcatggcaacagccagtgccataatcagctttagaggaaccgatactgctgcgtagaagaatgtgactccgaaggttttccaaaccttcgggtcagccgtaaacattcttatgtaattttggagtccaataaattttggacttcctaaaacatcgtattctgtaaaagaaagatataaagaaatcagaatgggaatcgcggagaatgccagaaaaccgataataaatggcataataaacagatatcccgcaactgcttctcttcttactgcggagttcatccgcttttcatttttcatcactgcgccacctcctggccgccagccctttgcaagagtctgaattattctgccgtacctttttgaagaagctctgctgcctgctcatagaagctatgagccgcttcttccggagtaatctcctggtaacgaactgcatctgccagatcgctgatcattttgccgatttccgccgatgcaggagggaacggaggatcgatttccgtagctacttttgcaacctccgccacataagcattgattcttccggtgcactcatctactactccattaacagcttctgtcacaacactggagatcggcacgcctctctctccctttaaggcttctgtgttagcctctacagagtttgtcaggaagttgatgacatctgccgcaatttccggattttcagagtctttcgtcacactataaaactgagacggcttaatgaagatcggctgagaaactgcatctgcttctgtcgggtacatataaatatcgtactgtacatcatcttcgcactgggcaatggtattgacaatcatgttggagttggtcagctggcaccactcttttcctgctgcaaagttgcttaactgattggtagatgattctgccatgacctccggtgaaacatggaagccctcatcaagcgtctccttcagtctggtgtaataacgaagggctaccgtatcatccggcattccgagtgctgttccgtctttcgtaaacatagtctgtccaagggctcttgccataaacagcatggactgttcatcgttgcttggaatcgcgatctgctggccggttttttcataaatcgtttttgcagctgcaaagaactcttcataggttggctgtttgggaagtgttacaccagcttcttccattactgcggtattaactaacagcgcttttgcattggttcctgctacaatggcgtaggtacctccatcgatctcaccactcttcataatactgtctggtacgttagtggtatcaatcacaccactttcaatatattgattcaagtctactaactgccctttttcctgatactggcttaagaatgcataatccatttgaataatatccggaagatttcctcctgccgcctgtgtcgccagtttatcccagtaaccattccagtcagagaactccacttcaaattttacttccggatgctctgcttcatacatctcaagagccttaacggtcccgtcatttctggtctgatttccccaccagcatacacggattacggtctgtccctccgctgctgcccctttcgttgtttcagcatttcctgctgtcgtcccttctgcggttcctgctgccgttttttccgaatccttagaaccacaccctgccaacatgcccgctgcaaggacccctgtcatagcaagtgctgctacacgcttccaaactttcataatcgtcaacctctcttcttcatgattttgattttcgctgctggtaaaatcatatcacgctttttcgtacattttaatcaaatttctttacctgttttgttcaatttcattaccttttacacaaacagcctgtactttcggccaaaatcatgctatattacaaaccaaacacaggatataatccggcattttacacaggggatactgcttatgaagcttccgcattttacctattcgtttaacgatctaaaactaaaacacagactgattcttatcattattgttgtggccgctaccattaccggttttactttatttgggttcaactatgtaatccaccagtataacaaacttctgtatggccagactgccaactcgctttccttcgtctctgacgaattaatgtatcagctggaaagcattgaaactgtctcctcctatatcgcttacggttccgcctttcaggaaaacctggccgtctgcagcacctccaaatcgtcgccgcttcctgcgcaaaaggcaagaaacgaaattattgctatctttaaccagtattatacgtctgacatggttcatctaactacccttacgcctaatggaaagaaaatctggtgggggaaaacaagctattctgaatcggaggaagccacacaacgtctgatggaggcatgtgacaatgccaacgggcgcctggtctggcgtccttccgaaaaaggtgcccgccttctctgcgcccgcaaaatactgaaggtaaaaaatttaagtttaaaacccatgggatatttaatcattgaaattgacttacaggatacggtacaggacatcttaaagtcccgctattccaacggtcagcattttgatttattcatcagcagcggtgaacagctgatctatccggccgacaatgaaagctatctccgtcattaccagaagcttttctcggatacccagccctacgccattaaaaatattgacggcaggcgcatgtttataacctttgcaaagctgccggttgaaaacggaacgtggcggatctccctggctgttccctatgataatattttccattctattaaccggttgattcctgtgttcgtgttttctctgattctgtcgatttctattgctacatttctggccggacgcattgtaaaaaatatttcctatcagttcaacatgctggtggaaaaaatggaacggattaaaaaagagggaattatgaaaccgcaggctgcactgacgccatccaccaacagtcaggacgaaatgaccattttaaatgcatcctttgatcagatggttgtagagttaaaaaagctgattgaggacagctatgtaaatgagcttctcatcacccaggcaaagcttaaggcactggagcagcaggtaaatccgcatttcctctacaacaccttaaacagtattaactggctggctaagagagctgggtcaaaggatatatccaccattgcccagtccctgggaagtatgcttcagagcacattgaataaccaggaaaatatgatttccattgaaaaagagctggaaatcgtatcctgctacgttaagatccagcagatccggtttgacgacctggtagtagaaatgaacattgacccgtccgcactggaatcagagctaccaaagatgaccatccagcctctggtggagaatgccatactccattctcaggaggaaccgcaggatgaatacgtgatccgtctgtccgttacggaggaaaacaacacgctcataaaggtacaggtggaaaacagcggttccttcatcgatacccggattctggagcatctaaaggatcagacggtgaaaccgaaaggaaatggaatcggcctcctgaatatcgattcccgcctccgcatcctattcggagacgattaccacttaaattttgataacagaaataatatggccattgtgtcattttcaattcccaggaaggcagaagcctcctcttctgacctatcgtgaaaggagtattactatgcataaattactaattgcagacgacgaaaaacttatccgtgaagccattgtggaattaatcgactgggaggccctggatatccagattaccgcaagctgtaaaaatggcatggaaaccctggatgcaatcatggatacggcaccagacatcgtaatgaccgacatccgcatgcccggtttggacggactggacttaatcgagaagctccaaagcctggattctcatattcaattcatcattctcaccggatacccggaattcgactacgcacgccgtgcaataaaatacggtgttcgtgaatacttattaaagcctatcagtgaggaggcgattatagatgctgtaaaccacgtaaaaaagtctctcccggtctacagtaatcccggtattgccgatctggtatcccgtcttttaatctgccgccaggaagggaatacagaacaggcccggctgctgttagatcacttttttactcattttgccaaaccggcagagctgcgccctgtcggcctcaatctgctaatggagcttcatacccaattcctgccgccttccgccgaagacctgtctcattttacggaacagatcctgagcgaacagaatgtgatgaatttgagagacattatcagcagacagattataagccttctgtttaccgacagcaaacagaaatcagcttttgcgaaaacgtctcttgccgatacagtgaaggcttatgtgtccgctcacttagacgatgaaaacctttcattaaaatacattgctgaaaacctgctgtacatcaatgtcagctatctgagccgaacctttacgaagcagtccggtgagaaattttccaattacataaaccgaagccgcatcgagaaagcccagagacttctgcgccagagcggcgccgatcacattcacgtcatcgcggaagctgtgggattcggcagcaatccccagtatttcagccaggtatttaaaaaatatacaggctctacgccgtcacaatttgcagaaaataaataggctgctcccgccgtactttacctgacgccgcgcaaaagccccgaaaccatctgcggtccggggctctatcatatcatgttcctgtattatgttcctgtttcgtactcctgttatattaatccaccgtcatatatgtccccagcccatcaaactggctgctatagctgactgcctcctcatactggttggactgcagcgccagactcacggtattgcagatgcatctctgcagtgctccaggctccagtgttccctccttcagctcctgacggatattgtcatggtctgctttcacgcccggcattaccatatcattgcctgcccgcatacagcccgcggccgtgcatacgcctgcggtggaggcagtggtggtggtccagtctgtcatgattgcgcctgcaaagccccactcgtctctggctgcctttgtgcagatatcgtaggaatttgccgcatggacgccgttgatctggttgtaggacgtcataatcgacatgggctgcgaattcttcactgcgatttcaaatccctttaaatagatctcgcgcagcgctctctcggaaaggacagaatcagaccccatacggttatcctcctgattgttgcaggcaaaatgcttgatcgtagttccgcatcccggaatcttctgaaccccgagagtgattgcggacgccatcataccggacagaagcggatcctcggaatagtattcgaagttccggccgcagagcggattccggtgaatattcatgccaggcgccagccacagcgtcacgttaaacagttccatctcacggccgatcatctccccaatttccttcagaagactgacatcccatgtctgtgccagaagcgtaccgaccgggattgcggtacagtactgatagtaggttgtgccttccggttcttcctgatcggcaaagaagccgccctcaaaggcctgtaggaacccgccttttttaatcataccgtccattacctgatatgtcttttggagccttaaaccggcaggtccgtctgccagtaccatgctggccacgttccatggggaatctattgcagcggaggatgtctcagccgcagctcccggcacagtaagtcccgcggagccaagggcgctttcctggccttttccaggatcgcctgtggcaagtgcaatcagctgttcctcggataaggtgctcacgatctctccggcttttccttccgtcacgcctaagtgttccggatacacggcggtttctgtcacgatctggtccgcacagaccgatatgccaggaagctttaaggattccgccagactcttccacgcttcctcttttgccttcatcttaccggcatccggcaccagttccgttaagtcttcttttctctcacagatcgtttcgcactgcaccatcacggcgtccgcatcgagacagatcgtagcagataagctggaggcttccagggaattccccacccagatgccatatgtacccgcctccaggatccatgccgccttatcttcatgataggaggccagctgatacagcgggaaggtaatcgttaaatcctgggtctcgtcaggagataaaagcgcagtctttccgaatccggccagacggcggaactctttgggcatattattctgcggacaggatacgtagacttccacaacttcctttccggcatacgtatgtccgatattcttcacggaagccgtaaccgagattttcggctggtctgtatccagaccggaagcgctgattccggttcccacaacggaaaattccgtataggacaatccgaagccgaagccgtagcgaaccggcacatcgaaggtatcgaaataacggtatccgacgaaaattccctcttcgtacttctccgtctctatgttgccgttcttatggctgaaggtctgggcattggggtaatctgcgtaggtataagcccaggaatccgtcatttttccgcttggatttacggcgccggaaaggatatccgcaaacgccgaaccgccttcctgaccggcctgcatgaactgcacgatggattttatatttgcaaactcctcagtaaaggccaggtcaatcagacctcccgtattgataacgagaactacgttgtcataggaagcagaaacctgtgccagaagcgctttttcttcttctgtgatgaagtaatccccttccgtatcgtgacgatccgcattttcccccgcaatacggctgagcacaaataccgcggtatcggctccatccgcctttgcagcctcctcgtcgatcgtattgccgcatggaacgacaaacggtgtggtggagtacgcctggaaaaagttgccgtcatactgtttcagtttatccaggaccgcctctttccaggcctgtcttgcatccgcgtaaatggtctcataagaggagagccatgcatcgctggtcacttcatagcctgcggcctttaacccctgataaatggaaacacagtcccgctcattgacatcgccggagccggtgcccccttttatggtcttgactgcccctgctccgtaaagcccgattttcccctttgcagcaagcggcagcagatggccgtcattttttaaaagtacaaatccttcggaagccgctctgcgggcgatctccctgttttcctgctctcttttcgttactgcgtctgatgtggaaccggtaaatgtcctgttttttaacttcatatctgacctccaaatggtatctgtctgtttttctctattatgcacgattgcctcaacggccgctagatacttttttaaccttttataggttgatattgatataatcgcaaacttttagtagaataaaaacagatattcctgtcactattgatatacaacagagaaaggaacgcaggatggatcacatcattcacgaagaagtttccgagaacaccaatctgccggcaaagctggagctcgtccattgtatgcccatgaccataccggctcactggcacgaatacttagagatcctctgcctgatcgacggccgcctgacggcagtcatccaggccgaaacgtatcagccggagccgggaagcctgctggttatcaattccaacgagcttcatatgacacagaccgcaggccttaccacctatgtgctgcttcagatttcggcggagcagatgaggcgctttttcccaaactttgaggcgctccatttccagacactgatcacgaaaggaagccaaagcccggatcaaaaggagatgttcttccatttggaagccatggtgagcgaatacgaaaaacaggcggacggctatcagcttctggtaaccgcccacctctatgagtttctctattatctctaccgctgctgttcccattggaacgaatccggaagcgatgacgattccagccgggatatgaagcggattgccggaattatggactacgtccgccggaatttccgcaggccgctgacgcttaacgatgccgccgcttcccagggcctaagccgggagtatttctgccgcctgtttaagaaatatacgggacagacatttctggcatacgtaaattctgtgcgcaccatgaatttttacgaagagctcctgaaatcggatgaaagcattacgcagctgatggtacagaacggccttacgaattacaaggtcttcatgcgggtttttaaggaaatgtatgggacaactccgcagaagatacggaaatctgctgcaaaatccgcagcaaaaaatgccgcagaatcactttttactccgtgatttgcggcattttatatttactgattcatgatgtattatgcgatggtctccgcatacttcctgatgttggaggcattggcgatcttcttcacctggccatctctcacgactaccagggtaggcgcctgcatgatgccaagctgttccgccagctctgcgttctcctctgcatccactacctcataatccacgtcctttaagaactgctttgccatcttgcagtttggacacgtcttggtcgtgaagaggtaggaaccagccggaatctctgcgttgtgaacggcttccttcaccgtctccgcactcttgcttcccttcttcagtaccgatccggtgatgtcgtaggtggtacggttcttgtattcctgcgtcttgccctcgttccagttctgtaccggtctgtagtagccggtgatacggctgtagatctcagcgcgctttccgcagatcgggcagacgctgtgttcgccgatcagatagccatgctctgcacagatggaatacgtcggtgacagcgtgtaatacggaagcttgtagttctccgcaatggtgtgcaccagtctcgccgcggccgcccagtcaggaagcttctcgcccaggaaggcatggaatacggttcccgatgtgtataaggtctgcagctcatcctgaatatccagagcatcgaatatatccgccgtataatcgacaggcagatgagagctgttggtatagtaaggtgtatccccttcggctccggccgtcttaatatccggatatctcttcctgtcatgcttggccaaacggtaggtcgtggactccgccggtgtagcctccagattgtataagtcgccgtatttctcctgataatcggaaaggcgctctctcatgtgatttaatacgttctttgtaaattcctgtgtctgtacacttgtcatgtcttcgcccagccatctggcattgaggccaacctcattcatgccgattaagccgatggtggagaaatgattttcaaaggttcccagatatctcctggtataagggtacagtccctggttcagcagcttggtgatcacttcccgcttcgtctttaaggaccttgcggaaacgtccatcatatggtccaaacggctgtagaaatcagcctcgtcctttgccaggtaagcgattctcggcatattgatggttacgacgcccaccgatccggtactctcgcctgatccgaagaacccgcccgtcttcctgcgcagctctcggagatcgaggcgcagacggcagcacatgcttctgacatcgctgggttccatatcgctgtttatgtaattggagaagtaaggcgtaccgtacttggaggtcatctcgaacagcagtctgttgttctcggtatcggaccagtcaaagtccttggtgatggaataggtcgggatcggatactggaatccgcgtccgttggcgtctccctcgatcatcgtctcgatgaaggccttgttgatcatgtccatctctgtcttacagtctttgtacttgaagtccgcttccttaccgcctacaatagccggaagctctgccatatcgcccggcacggtccagtccagcgtgatgttggagaacggcgcctgagtaccccagcggcttggcgtattaacgccgtagatgaaggactcgatgcacttcttcacctccgggtaggttaagttatctatctttacaaaaggagcaaggtaggtatcgaaagaggaaaatgcctgagcgcctgcccattcattctgcattatgcctaaaaagttgaccatctggttgcagagcacggataaatgctttgcaggggatgatgtgatcttgccgggaatgccgcccagaccttccatgagaagctgctttaaggaccagcccgcgcagtagcctgtcagcatggacaaatcgtggatatggatatccgcattcctgtgggcatctgcgatctcctgatcgtatatctcggacagccagtagtttgccgtaaccgcgccggaattgcttaagatcaggccgcctacggaataggtaacggtcgagttctccttgacacgccagtcctctaccttcacatagctgttcaccacatccttatagtccaggatggtattcttcatgttacggattttttctctctgttttctgtataaaatataggcctttgccacatccgtgtaaccggtctgctccaggacgtgctcaacgctgtcctgaatctgctcaaccgttacctggccgtctctcatcttttcctgaaagtccgccgtaacacggagggacaacagctccagaatctcattattaaaatccttctttgtagccttaaatgccttctttatcgcttccgttatcttattcagactgaattcagcgacctccccatctcttttcaatactgatatcatttatacctgactcctttccttttacaaccctgacaccgccttaaccggtgcattgtttattatagcagaagagaaacaaaaacacaatatctggtttcgcaaaaaacattaaaaccatatattgtgtcttattatgttttcttataagcttcgagtcacttatcgcaaaactgcggactgtctgtcagtatagcacaccttacacagtttctcaaccaccaattcgaccggtgtgctccgcagccgtacatttatgctttttgccattttaaatcaggtttgcatacatctccgcaggcacataggcgctgacaaaaataccgtcgtcccggtactcttccttcagaagctggccgtatttccggatcagctgtatctttccggcatcctgataggggtatacccgctccaggaatactttccggctcctcaaaatactctccagcagattcaggagctcgtccagtccctccccggtctttgccgaaatcttcacctggtaatcggaagataagtcgcgggggatcctcatctcacctgccgcgtctatcttattaaagactgtgatcacttccttgtcgtgaacgcccaaatccttcagcgtctcatagaccacatacatctgcatatccatctggggattggagcagtccaccacatgaagaatgatgtccgagtactttgcctcctccagtgtgctcttaaacgcctcgatcagattatggggcagcttccgtataaatccgaccgtgtcagtcagaagaatctgctccccgccgggaagctctaagtttctcgttgtcgggtccagcgtggcaaagagtttgtcctccgccagaattccggcgtccgtaagcgtgttgagcagcgtggactttcccgcgttggtgtaacccacaatggctgccaccggagtatggttccttgtacgctgctgcctggccacgtccctgtggcgcttcacatcctccagttccgctttcagctggccgatccggtcgtgaatcagacgacggtccgcctccagcttcttctcgccgggacctctcgttccgattccgccgcccagacgggagagcgagtttctcagtcccaccagtctggccgcccggtacttcagctgggccagctccacctggatcttaccttccctggttgtcgccctggaagcgaaaatgtcgagaattaccatggtacggtccatcaccttcgtatccagtgcatcctccagattccgaagctgtgcgggcgacagctcgtcatcgcagacaatgccggtggcattcagctcccagacgcgctccttcacctcttcgatctttcccttgcccagatacgtccccggatgaatccgttcccggttctggatgatcttgtccaccgtgacggctcccgccgtctccacaagctcctccagttcatctaaggaggctgctgccaggctttcctcttccgtactcacggccaccagaatgacccgctcttcgatttcctttaactccactaaatcagccattgatctcctaatccattaccttgtttttaaaaactccagttcccgcgcggcttcttcgtctgagctgtttcctgccacatactgctccatcagctcccgcgccttgtcaaagtctcccttgtactcgtatgcaaccgcctgattgtagatcaggtccggcaccgaggcggcgtccggctttaataatccctgggcgaaataggtaatagccgtctcataatccttttccccgaatttgcagaggcccatccggttgtacagctcggcattttcgattccttccgcctgggcgctctcatagagcgtcatggcctcggcggaggctccctggttctccagcgccgctccggccgcgagaatcgcctccgccctgcctggagcgtttttctccgtatccagttcggccgcacgcttataatcgtccagcgccccgcttaagtctcccgtctgcgctttggagacgcagcgcatgttcagatattccggccgctccttatccacctggatcaggataccgtaggtatccgaggcagcctggtaatctgcggcgcagtattccgcctccgcacggtatttcagtacgtcgatatcgaatgcgcccaccagcgcgttggaggcattaatcgcctcgtcgaaagaagcgatcgcactctcataatccccagcattcagcgcttctattcccgcatcgcggtacgtatatttattttcgctctttccgcatcctacggttaagctcatgcatacgccggccgtcaggacgagaagctttaatctggaacccatctttactctggaacatgttttcatcttaaattctccatccggggaggttactgctttccggtacttccgtggcctccgcggtcctcatggtcaagcgtgtccgtttcctcaaatgacagctccggctggtgcttcatgatgcggaactggcagattctgtcattggcgtgaatcaccgtgtcacgaagggcataagccgggaaaaaccactggtcattgtccccgcagtacgtctcatcgatgactcccatgctgttcgtctggatcacaccgtaattcttaaacgtgctgcttctaggcaccacatgggcctcatagccggccggcagctccatggcgattccaagcggaatcagctgaaactctcccgccttcagttcaatctcttccgccgcgcgtaaatcgatccagtcggatttgcctccaatgtagcataaacgctcgattttatctgtaaaatattttattctgatcttctctgtcactgtatgtcctcctgattatgagcacggaacggctgtctctcagccgcctgcgtgcggtagttattctgtgtttccaccgtcttcacgggttacagccgcttccgcgatcccgtctcccaactcggtgagggggatttcctccagaagcgcctcatcttcggggagcagctctccgcttccctttaactcctcctccacctccatgcggatctcggcagcggtttcggggtccggagtggggagattctgagtcgagccgattccgaaccggcgaaggaactcttctgtcgtggcaaacagtgcggggcggcccggagcatcgagacggcccacctcgtataccaggttatattccaccagcctgttcaccgcgtgatcggacttgacgccgcggatcttctcaatctccatcttcgtgaccggctgcttataggcgatgatcgacagcgtctccaggaccacatccgtcagcacctgttttttcggggtggcggccacacggatgagattctcataatactccggcctggtgcacatctggtagctgctctccagttcgataatctgcatccccttccgtccggcttcatactgcttcatgagccgttttacggcggatcttgccgtctcctcgtcctgtccgatcgcggctgccagctgtctcacctcgacggaattacccatggtaaataagaccgcttcgatcacggcctcatactcccgctcttcattcgtaatctctctcagttcctcaatcggcagcgactcctgcgcttcccacttcttcttcatcttttttatacccttcgatatcttcctctaactccgataagtccagatcctcttcctcgccttccggctccagcgtctcaataaacatatcgtcgaataaatgctcctgggtcagatgaatcttaccgatcttcatcagctccagaagcgcaagaaacgtcaccacgacctccgtcttgtccgcctgcctttcgagcattccccggaaagagaatttgcggtgcagcctggcataactcagaaccgaggtgatcttgtcctccagactcaccggttctctcgtaatattaccgaaccggctcctcacagggtcgatccggtcctctgtccttttcatcacggacttgaaaatctcctgaagctttgccagcgtcaggccgtccaacaggccatccaagtccaccggcggctcatacttcgccacctccggaggcaccgtaggccccttaaaaagcaggcggtccgcgccgacctccttctccttcagttcaaacgccatgtatttgtaatacttatattccagaagacgcgccaccagttcagccctcgggtcttcctcctcgccgtcctcattcacttctctcggcaggagcatgcgggatttgatgtcgatgagcgtcgccgccatcaccaggaattcactgacaatgtttaaatcctcggtctccatgtggctcacgtaatcgagatactgctccgtaatcgtcacaataggaatgtcataaatattcaatttattcttttcaatcagatggagcagcaagtccagaggaccctcaaaattctccagcttataggatattcccatagtttcctcccggcatcagaaagtaagcgctaccgattagtatatcaaatccatcggcttctgtaaatatttaacctgattttctctttgattgggcattaagaacgttgcagttcacagagtacggctgcatcttattaaatccaccaccacaagctgcggtttgttgttcagcctgatattgatggaatgcgtccccaggccgcggctcacgatcatgtacttcccgctctcctcaaatgttccggcgcaccacggcagaaagaactgaaactgaggggtcatgaccccgcccaggtacggaaggcgtatggttcccccatgaaaatggccggacagcgtcaaatccgcgccccatttccggcaggaatcgaaaaagagaggcgaatggcagagcaggatctgaaacctctcccgttcagccggtcccgccagccttccaatctcctccggccgcagatggtcgggatggaacttcttataataccgttctgccagatcgattccggtgacggcgatatcatcccggaactccattgtcctgttggaaaggtaacggactcccattttttttagcttcctcacataaatgtcatactgcatcccgaaattcttccgttcccggttcatccgcgtctcatgatttccattgccgtaatagacggggcagcgtttcgtcagttccccaatcagttccagggatacccgcagatccgcgctttccctgctgaccatcatgtcgcccccgatcaggatcacgtcgggttttacctcatcgaccgcatggagcaggcgtttattatgatctccaaactcatgatcatgtaaatcagagaggaacaccatccggcagtctctcgttatcttttccgtcagaatctccgtcctctctacggacagctgctccctctcatactgggagcgaagcaaaagtcccgctcctgcagcggcggacagcacaccggcggcaagccacatattattcttcctcatctttcaccagtcttccacttcattttatttcttttgatgccttttgattttgtatcatcatacactgaaaaagtatgccgcgtcaaggcaaagcatacttaagctttcgcgtttatccgaacgggctttcctgaatgggctttccgtaacggacctttccgtgaaacgaaaaaagccgctgtaccgttttgtggtacaatctcttcctgcaaatattgtcgaaagactggtatcgaagatagttgatattttgcaaaagatagtataaaatataatcatgattctaataatcatgattagaaagaaggattgctatgtttataggacgcaaaatggaactatcttttttagaagagaaatataagagggaagacgggcagctgatcgttctgtacgggcgccgccgcgtgggaaaaaccgaaacattaaaagaattctgtaaaggtaaacctcatatcttttattcctgccgtgaatgtacggaccggcagcagctactttcctattcagaaaaagtgttaaagacaggtattccagctgcgcaatatatacacgaatttcaagattgggaatctgctttcacaagtattttagaacttccgggtaacggtaagaaattactggtaatcgacgaatttccttatatgtgcaaagcaaatgaaacaatcccatctattcttcaaaatctgtgggactcctcattgaaagatgctaatataatgattatattatgtggcagtgcaatgagtttcatcgaaaaggaaatactggcggaaaaaaatcccctttatggacgtgctaccggcatctacaaaatgacagagatgcccttttctgacgtaataaaattttttccaaattacacaccgatggatcagataacagtatttgcaattttaggaggaattccgcactatttaagacaatttgataataagattactatagaagagaatatcaaaaaaaacatattgacaaaaggctctgtattatatagtgaagtagagtttctgctacggcaggaactcagagaaactgcagtttataataccattattgaagccattgctctgggaaacactactttaaacgatatattcaacaaaacgcaaattgaaaaaaataaactgacagtatatataaaaaatctaatggatcttcaaattgttgagcgggaattctcagttgctgatagtgtaaaggaacgtgcaaagtcaaataaagggctttatcaactaacggataatttttttcgtttttggtactccttcgttttcacaacgtactcggatctggaagctggagatactgaaggcgtaatgaagtacgtagtgacaccacagctacatgaatttacagcttttgtttttgagtctttgtgtcgtgattatattcgcttattaaatagacaagagaagttaccataccgctactcaaaaatcggcagatggtggggcagagttacccagcgcacagatagtggaaccgggcgtaaatcttatacaacatacgaaaccgagattgatgtcatggccgtcgatcagcaaagcaaacattatatactcggtgaatgcaaatacaaagcttctctcttcgatttagcagattataaaaccctggaatcaaaatggtcaaaaacagatgatgcagagtattccttttatcttttttctcaaagcggcttcacagaaccactgctccaacttgagtcaaaaggaaagctggtctgcataacattggagcaaatggtctcagatttcatatcacttttccctaatacctaataaaaggaatccgcctgcgtgtgacagattccttttataactttttaagtttatgatgttgggctgggcgaagccttgctctgaccctggcgtaaagcagcgataacgaactacaattccatacagtgagctaatggaacaggagcaaacacgcgggcgggatatgcctttacacattcgtatgttcacgttcccccactctattaagaaccaacaaaccaataatttctttaccagattaaaaagtctttattcaaaaggcggagaattccttccaccaaaaagtaatctccatagataacaggcacctcccggtcggcggcccggtcgtatctggcggagccatgggagacaatcgaatcctttttggggtcccactcacagtactcatctgtaaccgcctttaggcagcggacagccgacttcacgtacagatttttttccagcggcttcacgtgtccggccagttccaaaagtccgcacgcggcgcagactcccgccgtcgtatccaggtagcgcggctcctccggcgcccggaaatcgatcagcggcacatatccgtttatcgccgcgttggcgcagaaatagtgagccacccgcttcgatgcgtccaaatacgctgtgtttccggtataccggtaggccagcgccatgccatagatggcccacgcctgcccccggctccaggaggaaccgctctcatagccctgacctcccggatttcccagatattctccggtctccgggtcaaattccaccagatggttgcaggagccatccggccggatgatatatttcagcgccatgtcggtatgattcaccgcgatctgacggagtgcgctgtcatgaagctctcccgctgcccaatagagaagcggcagattcatgaggcagtccacaatcgcgattccggaccgttccccgttccacgcccttaagtatccggccttcggattatagcggcctgccagaattcccgccgcgtgaaggcctctcgttctggaagcctcgctgccggtcagccggtagtcggctacagccgtatgcagccagaggaagcccacatcgtgatccagctttatataggaagcgagagcctcatccagccgcatctcaattccctccgcggcctttctgtaacattcctttcctgccgcatgatacatctgccacagaattccgctgtagaacccatttgtccaggccgcaagctccttttttcccatatcttcgtagacgccgtttacaggaacgtagggcatcatggagcctagacggagacactgggcctccagcttccgttctaatttcccccagatttcctccgcccagatatgggtctcaccatcaatcttccagagcataacagtttcctcctccgatcacaatcttccgatccgtaaattctgtttctaccagtgtcccgatctccatttttcctgccggaaccgcgaaacggactgccggtatgcagacattggggaaaatgagattcatattgggcagagccgtaatgacaatgccgtctccgactccatgttcggcttcgatccggcttttgccatgatcatcggatacctccgcagctcctcttccctccgtctttttcgtctcctccatacagttcggataggaaaaaccgcagtcataggccacgcaggatatggtgctggttatcttatgtctgcgcttatggccgcctttcaccggcagaagccacgtctccacttcgatgccctccaccgggctccatctggaatagacaccgttctccgaaacacggtgttccagacacgccctccggacgtagtacatgccatgcgcgtaaaaagccagcatgctgtcgggtcccgcctgctccagctgatgaaaggagcgggatacacagaatccaaatacggacgaataggcaaacttggcgtatttttccgccgcaaacggatgctccatcaccggatactggcctgcggtcagggccacaacctcgtgtttccggtgacacagcaccatgtcgcattccttcaccgcaagaacctccgaaagcttcggaagcggctcgctttctgccttccagaacggatggctgtcaggcagagccaggcatacgaaggtcttaaacgaccagtagggcgagccaggggcattgtagctctccgacatcagcagattcggatacgtataaccgacggtgaggacacctccattgtcaaaaaccggctgcgccatccagtattccatgtggcgttccagaatccccttcatcacgccccatgaaatgcactccacaccggccagggcgcaggcgctgaaaaatgcagcctgcgcgaagcggtaggttaaggaacggccaaagggaatcgccttcccctcatcatcgaaccaatagagaaaggtctctgcaaatttcgccgcacggcacttgaaccgttctgcagtctcctgatcgtcctgtcccatgaaagccgcatagagaaggcagtaaaaatgaattccaaaggatgtgtagtaatccttttgcggccgttttccatcggaataccagccatttccaatataaaaggattcgtaccggtccatggcatcctttacctgttcttcactccatttcctccccacgctgcgcagcgccaggttggtgatcaccttaaagtactgccagttgttgtctgcctgggagtaccggttgatctgatacagccagtccgccagacggttcttttccttctcttccagcggatcccacaatttttccggaaccatcaggatcccgtagctgatcgcagccatttcgaccatccgctgatccttgtcgtgtaaatccccccagtatgcctccgactccgggtccgtgcccgcagagaggcctttccggtaaaccggcagaagactttcatccgtgcctccgccggcccagtacgaaaccagcccccacaaaacccgtgagaatccctccattccggcgatctggctgccgtatccagccgcggccgcccccagctccagatgggcgcagtctttgctgtagtgtggtttgagcggttctgccatatttaacagcagtccctgataatacgccttgtctctcattttctttctcctccttcactctataaaaatggaggctgctgcaaaacgccgccatccgtaccagctgcagaaatttctgtttctgcctccagtatcgattacatgcagttttacaacatcctcctatagcaccgttacacaatctctttaacggacgtatctgttctgtctctcctggtctattttgctttcagttcttccaggatttcctgatactgctccaccagttcctttgccgcctcttctggcgtaatgtccttgtagacgacctcctgaatcagatcttttcggatcacttccagctctgtattaccgctgatcatattattggtataggaatccggctctgatatctcgacgcctttcttctgaatttcactcactacacccgcggcaatcagaatatcatcagactgcctggttgggcagtaaccgacatcggtcttacagagagcaatcgattccggatcattcatcaggaaatccaggaatttagccgcctcttctttgtttgacgagttatcgttgattgcaaagcctctgtctccgctgtaggcgacgccgctgcattttgcatcactggtaacaggcattgaaattacatccagaggactctcgatggaagcaatatacttaggcgcgcttccggtatagtcaacgatcattccgatcttcccgttaatccatttgttgttctggtcggcctgtcccgcaaaggttgccgcttccccaaacggttccagcgtattggtctcatataattccactacattttgaaacgcttccgcagcttccgcttccgtaaaattcatggtataggttgcttcgtcgatcagcggtttccctgttttctgtgccagataaggctgtacaaacaaccggttcagcatgtcagcatctgcggtcatcagataggcatcctcatcctgctcatgaaccgatttccctaattcctttatttcatcccatgtgtagttcttgcttaaatcgattccataggtcttagcaaaatctgtatttacataggtaacggagcctcctaccgtacaggggaacatgttaggctctccgttgtaagtacccgcaatctccagaaggcggtccttcagcgtactcaaatccaccggcagcgtcgataaatccgccagatagtgtttcgccccctgaatatccggcagccattccttactaagctgtatgatatccggcgctgtattgctggagagtgtcgtcatgattttttcatagtacccgtcgtatccctgatattccgcctccacgctcacattgggattctttttttcataggcctcgatcaccgccaggagcgcctgatgcctgctgtcactcccccaccaggaaaagcgaagtgtcacgggttctttgctggcttctgtggttccagctgccgtactgtcattggcgcctgctgccgcagtactgctttccgccgccgtcgtatctgtcttcttatctcctgctcccgatccgcatcccatcaaggacaccgccgccatggaagcggccatcaccagtgccgcgcgtttcattaactgtttcttcataaaaatatttcctccttcatcgttttccctttacctgtattctatcacaaatccatttttccaagccccttctcagattgcaggtgcctatcataagattctatcttcatattataagcctatcattttattacttcacaggaaaactcgtcctgtgaaataataacgtgcttatcccttgatgcctccggctgtgattccttccacaaagtatttctgtgcgaagaaatacagcagcaccggcggaatcagcgacagaaaagacatggccagtatctggttccacggtgtagatgcgccctggctgtctatcgacatctttaaggccagcgacagcgtatagttcttcacgctgctgatatacaccagattgttgaagtaatcgttccatctccagagcgtctgaaaaataataacggagaaaatggagggcttcatcagcggcgccagaattctcacatataccatcagcggattgcagccgtccatataggccgattcgtccagctctctcgggattcccctcaaaaactgtatctgcataaaaatcaggaacggatagcatgccaggaccgccggaacccagaacggcaggtaggtgtcaacccagccaaacttattgaacaccacgtaccgcgggatcatgataaccgcgtccggcagcatcagtgtggagatcatcagcatgaacagcagcttcttcatcggaaacttaaatcgcgcaaagccgtatgcaacaatcccggtagaaatggcggttagtgcaaccgccggaataacaagcttaaatgtatttaaatagaatgtcaaataggaaaattgtccgcttcccttccagccttctctgtatgccgaaaaagagaagtgctccggaagcagggtcatctttccaaacagctccttattgtccttaaatgtggcgaaaaacagccagaacagcggataaatcatagctgcgcccacgacaatcaggatcacgtaggcgatcagattattctttttacttctcatcagtccattcctccatcgttatagaatacccacgcgcttgacgagcggaataccaggagcgtaatcaaaaggattgccacaaacatcacccaggaggatgcggaagcatatcccattttcaaattctggaaggcgtcctcgtatatcttgactcccatcaggtacgttccgtggttcggtccgccgttggtgataatgaaggcggaggtgaattcctgcagcgcatgtatgatctgcatgatcaggttaaagaacacgacgggtgtcagcatcggaaatgtaatattccagaactggacccatttgttcgccccgtccaccgaagccgcctcataaagctctgtcggaacgttcttaagccctgcgagaaacagcaccatggatgagccgaactgccagatcaccagaaggctgatggttacgagcgcgatgtccggatctcccagccagtcgacagccggaatatgtacggcgcccagcatcttgtttaacatgccttccttcataaacatgaatctccagagtatggagatggccacgcttccccccatgattgacggcagatagtaaaccgtccggaacaggttgatccccttcaggcgcatatttaagatcatcgctacgatgagcgccatgacgagcttcatcggcaccgacatcagtgcgtacttaaaggtcagaaagaacgacttcaggaagtacttatctttcgtaaacagcctgatataattgtcaaatccgacccattttccttccgataatatggagaaattcgtaaacgagtaatacagtgacatgattaacgggtaagcctgtaaaataaggaatcccagaagccatggcagaatgaagagcagcccccatctccagttcttcggatactttctcacggcagtgccccctgcggtttttggtttcagtgacgacatgatactttcctcctttgctgatttccggttgtcattcgcagcctgccgcaagcctttgctgccgggtctggctccaccggtttacgctccggttcctgtgactttgcagggcattagcagttcttaacgcgcagaatttttcgttcaggggaaatgaccacttgtctgagcgaagcgagtttgggcattttccctggtttttagaaaaatactgcacgtttagaactgcttatgcccgaaaccggaactggaaccggagcgtaaaccggtggagccagacccggcagcgaaggcttgcggcaggctgcgaatggcaacagtgtccattcccttcggaacataactcatggactgtattctatcatgcccgcttatttttgcgcccctgtgccgattgtgaacgcctatcatttcaatctatcattattttatccgcctatctctattttagggaaaatcgatttcatggttatacctttgactgtggcaactttcccatgatatactggaatcacttaattctgggggaggaaataccatgtatgaactactgatcgtagatgacgaggccagttcccgcgatatcctcgcgtcctgttttccgtgggacgagcagggctttcacgtatgcgggcagaaagacagcggccaggaagcgctggactatctaaaggatcattccgtccacgtaatcctgaccgacatcagcatgcccggcatggacgggatcgagctggcaaagagtgtttcggagctggaaggtgcccggcctatggtcgtctttttaagcgcctacgataactttaaatacgcacagaacgcgatccggtacggcgtccggtattacgttttaaaaccgactaatttttcagagctaaaggagatcttcggaaccatccgacatgagctggatgccaaatataatgtaagctccgacgatacccaggactactccaccgatgaaatcatccagaaggtcttaagctacttaagtcagaattacagggagggctccctgtcctcactggccgaatccctgtatttaaacccctcttatttaagccagctgatcaaacagaagacctccaaaaccttttccgatctgctgggcgaggcgcggatgaagcaggccgccctgttcctcaaggatcccgacaccaagatctacaacatcagcaacatgatcggctatgtgaatcccaacaacttcgcacgggccttcaaggcctactggggcgtcaccccgaccgagtacagaagccatgaaaaatgaatcaatccttgaaggtctggaacggaaataccattccaccacaatccgttttttcatcagaagcctgctggtcaacagtcttctgatgctgatccctcttttgctcatcggcctgtacagcatattccggacaacgaatgagagtaccagtgaggccgaaaagaaggcctcggtaatcttaaaccaggctgatgacattctggagaccttttatacccacgtggacaacgcatacctgttcttcgcgtccaatcccagggtgacgctgcagttaaagaaagcgtttgatgagaaatcgctgacgctggattccatcaagtccgtcgagaacatttcgctgaactttcagaacctgatttacaccgacggctatttgaggaatatctatgtctattataaaaatgactacagccggatcttcgtgcccttaagttcaaagctcatctcctttcctcctgacaaggaaaaggacgtcttaaactcctacggtcacgcaggcgaagaggacgtctggatggagttttccgatgatccgctgctgtatacagaataccggactcccagcctgttggtctaccggaaactgtaccgccgaaccaccgatatccagaacggactggtcatcttcagcttcagcgcggacaagctgaagagtgagctgtccggcctgctggaatttccggatcagaagctctttctgatggatgcctccagccgcctggtctggccttcaacagaggaatttccggaagacgaccttctggatcttgcggcgcagatggcctcccttccggccacctcccctgcggacgccgtcaacctggactataaatcgtatactgcgacgtacctgccgtcaccgagatcctacggattttcgtatcttctgctgacccccaggaatgaaatctaccggacggccatcagtctgaccagcatgtacatcatcatcacgctggcggcgatcgcggtagcctgcatgatcgcatttttcaagacacggcacgattacaaatacctcgataagattatcagcgtattcagcacaccggataccgcagtcaatcagatccgtcagccaaagaaaggcagctccagcccatttgaatacatcttgtttaacgtaatccgcctcttcatcgagcaggactacttaaaaatgcaggattccgaaaaagcagccaagctccagctctccaaaatgcaggcgcttcagcaccagatcaatccccacttcctgcataatacgttaaacaatatttactgggaatccgtcaaactgaccggctcggagaaccggtgcagccagatgatatcgtatctttccgcgatcatgcgctactcgctcagtgatccccaggataacgtaaagatccaggaggagatcaactacttaaagaaataccttgaaattatgaagctccgctacaccgaccgcttcgatgtcgatttttccctcgcgccggactgctctatctacccggtcaaaaaaatgattctgcagcccctcgtcgagaacgcgatctaccatggaattaaagaaaagaaggaaaagggtctgatctccatctccattcacagaaaaaaggaccgtatctacttcaccatttatgacacaggaaggggcattccagccgatcagctggcttcgatcagagcaggcctaaaagagaccagccgaaactccaatcagcatatcggactggcgaacaccaattcccgactggtcttatcctacggtgaaggctccgttctgcatatgaacagccgctgtggaaagtttaccgtaatctggttttccataccggtacctgaccaaacataaacgaagaaggcatgccgcggttccccgcgcatgccttcttctctattcctgaaccgttcaaattatcacctctgtccggatcgtcctgtattacggattgtcttctacttcacccatacgccggacgcgtccagcgtatatccatccggagtcaccgtattcttcatcatcgccccatcggcgcccaggtaaaaccattggccgtcggactccacccaggtactggaagccatagcgccgccggacttgaaataataccacgcgtcgttggaataatggcgccagcccgtagccatggtcccgtcggaatcgaaccagtaatcagccccgtctatcgtcatccactcattggcggcgcggtttccgtcgttctttacaaagtaccactttgccccctcctgctgccactttgcagtctgggagcctccgctcttcagcgcaaaaccgtagtccagcagagccgaggtatccgtatactgtgtagacttgctcttcatgataaccgcgatcagacgcacgccgtcccgctccgcacatgtcaccagcgtgttgcctgccagtgaagtatatccggtctttcctccgataacgccctggtagtatctggcgtcattgggatacagcatcttgtggcccagggatatcgtgcgggccgccgccttctgcgtcgccggaatctggtagcttaaggtcgatgcgatcttgcttaccgtaccattctgaaatgccgcccgtgcgatcagcgccatatcatgaggcgtcgtatagtggttggaattgttgaggccgttcggattgacgaaattcgtgttcgtacagcccaactccttcgccctggcattcatcatgtccgcaaacttgctgatactccccgccgtatgctcggccagaccgttggccacctcgttggcagattttaaaaggagaccgtagagactctgacgcaccgtcagcttgtccccttccaccagtcccagtgtaacagcaccggactccagattcgtaaccgctgtcttggaaaatgtaaccgtatcgtcgagactgcacttttccgctaccagaagagctgtcatcagcttcgtgatgctggccgggtaaaacttcgtctctgcctccttcgaataaagcagatttcccgtggccgcatccatgagcaccgcgccctgagcctggatctccggctgttttaatgtgttcaccacactgccgccggtcccgcttccctgggtggcccctgggcctgcggaagttcccggccctgtcgagttccctgatccagcggaagttcccgttcccgtcgaattccctgttcccgtcgaagctcccgggccgctctgggtattatccccgccaggtcccgctgtctccggccctgaaattccgttatccgatccgccgcttatgggcgggacgatcggaatatcaccgaaggccggtacggaagccaaaaggcttaagctgattgcaatgctccatattctgttaaagcgttttaccatgtctgtttctccccgtgtcatcctgtattctgtattatgtacaataacctttatcctgcatcggcacacagtacggtccgctgttccgccttaggccggacaactgccaggtaaaatcttatatgccgatttttatctgtagtatttccttgtttcaatccacgctcgataatttcacagagtgcgactacatcttatagatgcgcggcttgacttcatgtcagcgagggataccgatttttctctgcccgccactgccgttaagcttgtttttggcgtttcatccctccacctgcagaggtgggggaattctcgcttgtttccttaaacagtatagcacaaaattgcacggatacggattaaaattttcttacaataagagagcacgcccggcggaggccggaaccggataatccggtccctgtctgcgccaggcgtgctcattttatgccttatctttttttattttctgccttatgggcgtttttccacatggcccaaatcacgctggccacgcatatagaagaaaagcagccgctcacaagtccgaataacagaggcagggagaattcaaaaatggactggatcccaaaatgccacgatgcaatcaccaggatcagtacgctgatgcacgtcgtcagcgaggtgtgcagcgaccgtccaagactctgggatacgctggtatccaccagctcgtcgatatttttacacttatgaagattcatgttctctctgatccggtcatagatgacgatcgtatcattgatggagtaaccgatgatggtcagcaccaccgccacaaacgcgtcattcagcggaatcgcaaagatcaggaacgcacacagcacgatcagcacatcgtggatcagcgcgatcaccgcagatactcccgcagaaaggcccgaaaggatggaaaaccggatccagacatacaccgttatcagtaccgccgccagaaccatggcgatcacggcgttgtggagcgtcttctgccccatatacggctgaaccgcatacgtctccgacagggtcgccgtaaagccatcctgatagccgtttaagatctgcgtcacgtattcctggctctccgggctgatgccttcctgccctgcaaaggtcagaaccataaactgttttccaaggccatcctcctttgtcaggcggacatttacatttcttccggtctcgccggataccttggcagcaacggcgtcggaattcacatcggccgcgccccgggtctcatactttaacgtcgttccgcccgtaaactgggtgtccaggctcactccgttcttcataaatcccagcacgccggccaggagcatacagatggagatggcaaaccatatgtatttccgtttcatgatcggataaatcttctggttcttcttcaccttataccacttcaaatcgtggaatctgccttcccgtatgagggaaagaagcacagtcctggagaaccagactcccaccaccaggttgatgatcaggcccacaagcagcgtatagccaaagctcagcatggtgcctgaaccaaagaacatcaggattatcgccacgatagcgctcgtcaagtttccgtccagcacggaagagaaagccctcttgtatccccgtttgaccgcctcggtcagcgaaacgccgtttccaagctcctcaccgatacgctcgctgatgataatgttggcatccaccgccatacctatggtcagtatgatgccggcgataccgggcagtgtcagcgtatactgcgggatcgagatcgccagcagctgtatggaggtctgaagaatcaggccaaagcatgccaccattcccggcaggcggtacatggcgatcatgaaaatacagatacagaagaacgctaccacacctgaaaataccatgatattcaaggcattagagcccaggctcgggctgatggtgctgaagttcttcgtctccatggcatacggcagggcacccgcattgatcttgtccgataagctctttgcggacgcatacgactccatgccgttaatcacggcgttgccgcccgtaatcttgtcctgaaccaccggattggagatcagctcctcatccatgtagattcccatgcggcggcctaccagtttaccggtggcatcggcaaatttgtccgcgccgtcctttgtaaactgcagctccacctcatattttttaattccggtctggtccgaatactctacgggccggctggtggagatgtcccttccttccagcattacagtgccgctctcatcacggaaggtcaaattggccatgtcgcccagttccgcgatggcagcctccggcttaaaatccttttcgtcggatttccacggaaaacggacgattacataacccttttcattatccgttgtcacctcgcggtccgtgatattcttatcatccagtctcgtctcgattatattcctggccgcttcgatctcattcggcgcgggattccggtctaagcccactggctcgaatacggcctcgacgccgccccggatatcgattccaaatctcatgtcccccgcgcccttaatgtcttttccaaggccgaagcatgcggtataaaccgcaaggatgacgattaccgtcaggattccaagtgttttctttcctggtttcatagtgctctccttttcgtctcatcgcagagtgtgtttgaaaattcatttccgccatctgcacgccccactttgtgggagcccccgccccgattcagtcagcgtagcccactacgcctccttcatcggggtgagacctcccgcaaagtgtgacgcacatctgacgaaaagcaattttcaaacacactccagtcttcttatcgtcattcattatagactgttatgagagaaaatggtgctaagaaaccattaagattttccccgatccctccaccagcgctcttcttccagttccttccggatctcctgtatgaataaaagcagcacaacgatggatatggaccccatgatccccatcagaatcttcactgacacatcacctctttacaatttcataatattttttagaagtaaccccatagatcaccccgtaaaagacagcaaacagcagtaccgccccggccgtggacacggcaaacagcccgacattccgcagattcagcagtgccagcagccttgcgatcatcggaaatgcgaaacagatatggacagcggccgtaaccaaaggcagaaagaacatggtgagcacctgggaacggatggcgctcttgatctcgcgggccgacagccccacattctgcatgatttcaaaccgcttcttatcctcgtagccctcggaaatctgcttgtaatagataatcagcaccgtcgccatcacgaacagcgttcccagaaacagtccgacgaagaacagccctccgtacagggagaaaaaggacccccgctccatggctgcggattcgaggcggcaggtcaatcccagaccatttaaccgttcctccaaatctttgtacagtctggcagaaccctccttgccgtctccggcgtcgaaggccacatagtaaatgggtctggatttcgcctccccgtaggcctcggcctgctttttctccatctcctccagctgggaaaaattcggcaggacgatatgaaggcttcccacagaccccatggcgtccataccgtcctctacggtctggccttttaagccggcgacatcgtaccgtcttccaaagatagaaaatgtatcccggtcgtaacgcctcccatccgcaagcaccatcacctgatcatcacgcaggctgacatttttccctgaaatccggttatagtcctccagagtcatgaagaagagatagtccaggctgttgtagtccgccagattctcctcccttacctcgtagccgtctcccgtatccactgcggcaaagctgacatagcggtagctgacaagcccctttgcggtctcccccgcatcctttaaggcactctccacaatcccgtcggtcttcgcggccgtgtcgtcggaataatcgtacaccgtcaccacgtaatcccgtttaaaacggtttctcatcacatcgtccagtcccacatagagagaaaccgtggaagaaagcatgactaaaaccgctgttgacagaaggcagatcacagacagaccggccgcattctgtttcatccggtatatcatacctgagacagagatgaagtggcgcgtctgataataatagcctttattctttttcagcagcttcagcagcgtaacgcttcccgcagtaaataagaggccggtaccggcaatcacgaacagaaccgcgatgaagaaggcaaaaatgatcatcgctgtccgctccgtcgagacagcaatccagtaccccgccgccagagaaatgacacccagcacagccagcagccacggcgcctttggctcccgctcccccgcctgctttcccgccagcatctccaccggcctcgcctttgcgacctgccatatattatagaagagaatcaccagaaatatgacgccaaagagcttcacacacgcaaaagccgcctccgggacaaaactgaaatcccaggaaatatccagtttcatcaggcggtacagcagaaaaccgagcagaatcccggacaccaggctcaccgccgccgtaagcagcgtctcgatcgccatgattcgggccagatgctttttccccatgcccaggacctgaaacagcccgaattcctgctttctccgtttcaccagaaagctgttggtgtaaatgagaaacattacggagaacacggccatgaccacgcagccaagcatcagaataaatgccatggagccgcctccccgcatacgggcaaagcccggattcaccgtcagggaagagataatataatacatcatcacggagccgatgcaggtcagaagatacggaaccgtgacggctgaatttttctttaaattctgaatggccagccttgtgtaaaacaggttattcatcgcggccacctcccgcctctaagacggccagagtatcggaaatccgctgatacatcttctcctccgtcatttcgccgcggtagagctgatggaacacctccccatccttgataaacagcacccgttttgcatggctggccgccttgacgctgtgggttaccatcaggattgtctgcccctcccggttgattcctccgaacagatcgagaagctggtcggaagcccgggaatccagcgcgcccgtaggctcatccgccagaatgatcgccgggtccatcaccagggccctggcaaccgccgccctctgcttctggccgcccgagacctcatacggaaatttcttcataagctccttaatccccagttttcccacgatggggtccgccttctgtttcatttccccgtagttcttctttgccagtaccatgggcagatagatattgtcctccagagaaaacgtatccagcagattaaaatcctgaaacacgaagcctaagtggtctctgcggaacgcggccagctctccctccggaatcgttttcatatctcttccgtttaagaggaccgcgcctccggtaggtttgtcaagagcggctaaaatgtttaatagtgtggttttccccgatcctgactctcccatgatcgcgacgtattcttccttttccaccgtaaaactgactccgttcagtgcatttatctgatttcctccgaaacgggtggtatagaccttttttaattggttcacttcaagcaatggcataatgctgcctcctttcctatgacagcagtatatcagacgggaaagagcggccgccatcgatgaggcttacatttttctgcgtatccttacaaaaatgtaagggaagcttaaagactgggaccgcattccggtggtatactgaaatcacaaacagatcgttatccatgcagcggaaggaggtatttccatgtacagcagttttgaacagcgcgcacgccagaggggcgcctacaccattcaggaatttgaaaacacccatggacgccctggcaaatcccgcacgcccatatccggatataaccccaaaaaagccatgaaacaggcggaaaaagcgtatttggaatccatgggaatccataagaaatccctgtttcaaaggattaaggggctatttatttcataggccagtttcagaagcctctctattccggtataaatttcgtcatatccaggagcagcttcactttcgtccccactcctggttccgattcgatcaccatctcgtgcgccagacgggtcatgacctttttgcacagatagaggccgattcccgtcgatccctgacccgcgcggccgttacagcccgtatacccgttctcgaacaccctggggatgtcctccggggtgattcctcttcccgtgtcttcaatcaccagcgtccgtatgacttcccccgccttacgttttgccgagctccgttcggaggggctttccgtctcctgatagaccgagattctgccgctctccgtgtactttaacgcattggacagaagctgttctatgacgaacagaagccatttttcatcggtccgcaccagacaggctgcgggtctgtaatcgagtgcgatctttttccggataaataccggagcatacttgtgaatggcttttttgacgatggcgtccagcgagcattcccggataaccagatcggcagaagggctgtccgcccgcaggtactgaagcaccatttccacatactgttcgaccttaaaaagctcattggacagctggctgtggtccgtttctccgccagggtgtgtttgaagaatcaggttcatggccgcgatgggggtctttacctggtgaacccacatggtataatagtccttcatctccgtccgcttctcctcttcctcccgaagcagccggtccctctcctcataggaagaggcgagaagcctccggtacagaagctccagctgatcggaggtctcctcaaagggttccgcataccccgtcttctgggccgccattcgctctaagtccccgcattttttgcagtagcgggaaaagcttcggacggacagaaggagccccggcaccgctcccagaatccaggcgtagagtacagcctccacgggaagacggtacagccagaatacggccgcacacaggattccgccgcagacgcccgccgtaattaccgtacggttcctttttaaatagaggcctgtcagagacagcagcttccttcccttcattttaccatgtaccccatgcctttcttcgtgacaatgaaatcctcaaggccaacgccgtccagtttcttccggagccggttcacattgacggtcagcgtattgtcgtccacatagctgtccgtctcccacagcctcgtcatcacctcttccctggagacggtacgccccgcctgttccatgagaagcttaagaatccggaattcattcttggtcagttccactttcgtctcctgataagtcagagtggcgtcattgatgttcaggactgctccgccgtgttcgatcaggtggtgatcccctgcaaaatcatacgtccgcctgagcatagcctggaccttggccgtcatcacattcagatcgaagggctttgctataaaatcatcgcctcccatggaaaccgccataataatattcatgttgtcggacgccgaggacagaaagatcacaggcacattggaaagctttcgaatctctccgcaccagtaacagccattaaagtatggcagcaggatgtccatcaggacgagatgcggttcgaaggccgcaaattcggccagcacatgcttcaaatccttcacacaggccgcctcatagccccactcccgcaggtgattctgcacggttctgccgattacctcatcatcctcgacaatcagtatcttatacattggccgcctcctcatttactttcgttccctattctaccagccaaatcttaattttttctttaaatatttcagaagctttgctaaggaactgttctgttttaaaaccgtatggattattaatgaaaatgtaaagaagtccggaaccggaagtggtatactgaaactaagaagaagaaagggggatttgaccatgattaccatatttaaccgcaaagagctgtactccggtttttccatggtggaatgctcccgtatcggacggattctgaaaaagaataagattccttatatcataaaggaatgcgatttgaatccgatcagaccgggattcatttccacatccgcccccatgatacagacaaagcccataagagaatactctttatacgtagataaaaaagattacgaggaagccagctttctgctcacctgtgaagagggctgcgtctgacctccccatttcccggaatgtactgcatgaatcacgcagtgcctgataacgcctttcatacaaaaggccgggaaaccaaagtatgcttctttggtttcccggccctctctctgccctgcggcagcggtcttttgcctcgtcattccagctgttcgcggtactccttctgcatctcctccagacggtccagcgccgtatttaaaatataggcgtggtcgaaagccagcgcttccgtgtcattcacatcgatcgcaggcagcagttccgcatgtgtatccttcttccacatgagtcccatgtgggtatatccttccgtaatccggtatccgatgaaaatatgacgttcctcgttctccacagtcagggcgtatgtcgcaccatctgccagatccgacagcttctttttcttaacctgaaaccacacggcttccttcgcatcgtctcctgcgaccggattcagttcgtccttcggcactaccgccatatacgatacagagataatccgcgtccgcgggtcacgttttacactgccccatgtatagagctgttccatgcagacaccggtgatcccggtctcctcctccagctctctggccgcggcttcctccagcgattcgtccatattcacgaatccgcccggcatagcccactggccgatacacggatggttccgtctgcggatcagcagaagctccgggtcctcatcctctgcctccggatcgactgcaaaaatcagcatatccacagtcaccgacggccgctcataatttccgggcctgtactgtgctaagaattctttctcggtcagcccatcttcattcttcagttccataggaattcctcctccccggtccctgcggcccggctttaaaaaataacagaattaagcgctcccaaaacgcccacactggccagtcccataatgactccggcaagaagtacgcctcccatgactgcgaggatactggatttgaagtcgatgtcgagaaggctggctgccagcgtaccggtccacgcgcccgtacctggaagcgggattcctacgaacagcagcagagcaataaacagccctttgcctgccttcgcctgcagcttctcgccgccgtgctttcctttttccagacaccacgtgaaaaatccgccgatcacgggcttgtccgctccccattctaaaacctttctggcaaataaatagatgatcggaaccgggagcatgtttccgataatggcgatgatatacgactctaaaagaggcaggcccatcacctgggaataaggaatggcgccgcgaagctcaatgagcggtaccatggaaataaaaaaaaccattatataactttgtaacatcctgatattcctttcctataaaaagtctgccattatactatacacaaagatcgggatccttacaacctttttagaaaaagataataaatttatgcggaaaattaatacgggaaaccgctgattcagcagttccccgtagagacgtatttcagactttccgcttatttgtaacccagtcccggcaggatatttttcggataatccaagaacagcatatccgccttgtcgtccaaatagtggcggttcggatggataatcaccagccaccgcccggtaaaatatttcacgtagtttccgaatacctcggagtccagcgtcgttccgagaagcagaaggacctctgccttcgatatctcattggaggtcttcgtcatcaggcggctgtccaccatctcaccgaacagcgacacctgcgggcggatcgggatatcgcatttgtcgcagagaagtatctttttcgcatcccgcacctgctccatggtgtattccctgccgcagtgcgggcatttattctcatagatcgtcccgtgaagattcaccacgtttttgcagccggccctctgagcctttgcataaatattgctggtgatgagacactgcagcttcccggcccgttccatcgctgccagtgacggaccggaatccgtgtcctccggcggattctccagcatctctttcttatagaattcaaagaaaaactcgggccgtgtattatagaaggcgctggaaaagatctcttccgcagaatatccgtacttcgtctcgatatcataggctttatcgggattctttacccctataaagccgccctcctccatcatgccggagccgcagatggccaccgtgtacctgctctcatcgagaatttccctcagttttgaaatcttaccttccataataaaaccctcccttcaaagcttcttgtactgctctgttttatgataatattatactatgaaataacagtattttccatgttatattctatttattttctcttttttcttctcatactttattcgtgcggcaaatccctgctttccgcacaattgcacagtgtattcaatccctgaaaatacaaaatgccgattccatggactaatttgaccttatccatggaaatcggcattttgcatctgaacgttcgatctcttacatcggttttctcttcgtattcggtcccataccttcccggcgtgaattatgggtctgattctggttttccgtctttaccttctcggtaatgctgttgaaggtctcgttcgatttcttctgcgccagtttttcctgctgatccttgtccatttttatcacctcacggatagtatgagccggacaggagcattgtactcatgaccgcagaaatgggagcttaaactttcgtaataaaaatcttaacatttcgttaacccccttgtactctccaaactggtgtgatataatccacggaagttggtaatatatatcaatagtatcagaatctgacaactcacacctaacaacagaaggggttgatcttatatgaaaaatctgcttcacaagtacaggcacgcatgggttttatgctacgctttcatctacattccctggttcgtttatttagagaagacggtgacgagcaattatcacatcatgcacgtcgggctcgatgattatattccgttcaacgaatacttcataattccttacatgctctggttcgcctatgtggcgggcgcagtcctttatctgttctttacaaatgttaaagattattacaagctttgtaccatgctgttcaccggaatgaccatcagccttctggtatgcaccatatttccgaacggtacggacttccggccggtcattaacccggataagaatatctgctccgccatcgtagcgtggctctattctaccgacacgtgcaccaatgtatttccaagcattcacgtatacaattccgtctgcgtccatatcgcagtcagccacagtgaacggcttaagaagtatcggtccgtacagattggttcctttgtcttaatggtttccatctgtctggctacggttttcttaaaacagcactccgcgttcgacggtctgggagcggtcatgatggcatacgtcatgttccagtttatctacacggacggttacgtcaccagcagaaagaaagtcacgcagaaagctatcagttaatacgaaacggtcacccggcgccagccgttcgggccgccataacaatcaagagccttcagtcgatccgatcggctggaggctctttttcactttataattctgcaaatcagttgaaaccgaagaatttctgtgtaatcttgtatcctgcaatggaaaatttgcggccgctcttgcccggaaggttcgttccctgtcccaggaatccccatctcagccggagatacagcgtgagattcagcttgcgcagatactgccacagctccttcttcttcgccatgttctcctctgtcccggacttgatcgccagtatggaagaaaccgtcatcataatctcgagatagcgcaccatgtagcggcggagcttgcgtttcttcagcttcgtgacgtcgcagtagccaagcatcagcttcgtcacgcggatctgctggtcgattcggccgatcatgacctcctcgttcaccgactggtcttctcttccgataaaataccggtaaaaattcacatttaagtagtacatggtctttacatgaggaagcggctggtatacgaaaatattatccacatagaatgtatgctttggaagctctaatccgcattcccgcagaagttccgtacggtaaatgacggaatgcatcagaatatactgccccagcatgaagaccttcacatcatcccaggtaaacagttcgttctgcggaagcgccgtccggtagttcataaccttttttcgcttcgcgccctgtttctcatagacaaagttgctgatcagcatgtccagcgtctcctcgccgcatacaaaccggcgaagggtcgagagtatctcctgataggccgcctcatccacccagtcatcactgtccacaactttataataaatgccctcggcattgcgaagtcctgtattaactgcctcaccgtgtccgccattctcctgatggatagcccggcagatacccggatactttctttcgtattcatctgctatctccgctgtacggtccttcgtggagccgtcgtcgacaatcagaatctccacctcgtcgcctcccggcagaagcgattcgatgcagtgcctcatataggcctctgaattatagcatggaattgcaatggataataacttcacacttcttcctcctttatattcgtcttacgttctattctgatcaaacaaaaaaccgagagaacaactgccagcgcaagagcggtataaaacgcaaacgccgaccttttctccgccagaatcccaagtcctgtattcacaataacaatcgatgtaacatttgccgcagcatgaaatacccagggagcggccagcgtctgaaaacgctcataaagccatgccatgaccagccccagaagaaatgcatagactccctgaagcagattgccatggtaaagcccaaacagtacggccgatatcagggcggccggccagaacgccatccggtctcttaacggagcaaacatcagcccccggaatatcatctcctctgccgcaggtatcaccagccctggcccgagtatctgaatcagaaacggaggggagtaaagcacttccccgacctcttcgaaaccgggagaccactccggcagcggtgttaaactaatcatattattgacagataaacatattccaattcccaaaaggataaggatgggaaggcagccccgaaaccgaaatggtatgggcggcatcacgccccgtctggcctgatcgaaccgataaggccagtaatagagtaccggaaacgtaaccgcggcacccagcagagtgcacatcagagcctgtaacggcagcgtcagcgcgatgacacccgtcaccagactgtaaaacacaagcggaagtatcaggtacagaaccaccatcagtctctaacctctctttacctatattaatatgaacattatatcatttcttagcaatatatccagccccaattttctaaattattccttatcatttcctgatttttatgtccggttcccgccgcagcgccggtatgacaagggccggcgggtgctttatacagtgacggcagcccggcacacaatcctgtgaaaataagaactggttgctttttctgtgtccagataatataatatccttatacttttttgattaaattacatcgaactgagaggtaactgatatggcaaagaaacgtattgttatggcattgggtcacaatgccctgggaacaaatcttccggaacagaaagaagcggtgactgaaacggcgaaagtaatcgcggattttatccaggccggatggcaggttgctttaacgcacagcaacgctccgcaggtcggaatgattcacacggctatgaatgaattcggaaaacagcatgacggttatacctctgctcccatgtccgtctgctcagccatgagccagggatatatcggatatgatttacagaatggaatccgcgcagaactggtaaaacgcggtatctataaaccagtagccaccatcctcacccagatgatggtagatccatacgacgactccttctacacccccatgaagccggtcggccgcttcatgacggccggggaggcaaaggaagaggaagaaaagggaaattacgtggaagagattcccggaaagggattccgcagagtgatcgcatcaccaaagccggtttctatcgtggagatcgacgtgatcaaggctgtcatggatgcggatcagatcgtcatcgcctgcggcggcggcggaattccggttatggaacagggctataacttaaagggcgccagcgcggtcattgaaaaagacagggcggcgggacttttagccaaggagatcgacgccgatgtccttatgatcttgaccagtgtcgacaacgtcaccatcaattacggcacgccggatgagcgtccgatctcacacatgagcatcgaagaggctgagagctatatcaatgaaggacagtttgaatttgcctccatgctgccgaagattgaagcgtccgtggacttcgtcacacacggcaagggccgcagcgccatcatcacctctctttccaaggcgaaagcgagtctggcaggcaaggccggtacgacaatcgagtaaaagaaaatccgttacatttatgaagaaatccctccatctttacaggtggagggattcatcgtcatagaccagagaatggaaacaatcgttttatttcaggaggctttatgaaagttgattatcatatgcatacgctgtgttcagacggaatctacgaagtggaagctgtcgttgacatggcggtaaactgcggaattctcgccatggcggtcacggatcatgacacgctgtcgggcatcggcagggccagacagtgctgcctgggccgtatccgctacgttaccggcacggaaattacgtgtgcggaacagctctggggaagtctccccacttcccagtccatccacctgcttggttacgggttcgatgagaccgatccggtgctgtgcgcgctgctctccgcccggaaagagcggacggaagccgtctaccaggaactggcagaggctgtaaccgcgtcaggatatccgattcgtatcccggatgtccccatgagctgcggaaatgtccttcagcttcgagatgtcatggctcacgtcagggcagcttaccctgcggtcagcgaggaggccgcggaactggtcgattcctatgcgaaagccctgacagaagccaatatcactgtggaagacggcatcgcagccatccaccatgcgggaggaaaagccgtctgggcccatccttataactgctaccaccattttcagaaacagtccctccatgcacaggaggtgtccatcatgctgaaggagctggcactcctgggaatcgacggcatagaaaccgaatatcccgcattctccgactcagaaaaaagctttttaaacggactcgccgctgaatatggactgtttacgactgccggcagtgattttcatggttccgaaaacagggaccatatggggatggagacagatcaaaactcctttttattatagaccgacacgctgataaagtacgagagcaccatcatcacaacggttcccagagctcctgcgatgatgacggcagtcactgtgctgtcacttacagcaatatcatccccatacgccgacgcaagtgctacgatcaaaaagactgccactccaattaaaacgctgggaatcattctggccttctccacacccagccaatacgtgagcgggatggagatcgaattataaaagaatgccagggcaacgccggtcagccagttaatcagcagctcaaacagaaattccggtcccattcccatgccttttatggctgtcgcagcggccacagccgccactgctataatcccaaagaaagcagcaatacagaccgagtaaagatacttctccagtaccatcttccagcgcgggatcggcatagtcagagcatacgtctcccactttgtctgcctgtcgtaggaaaacagattcagtacattcattccagctatcatgataaacatgggaatcaggaacattcccgtctttttacctcccagaaaagctattgaccacaccacaaggataaacagcattgactttaaactctggcgcatgatatacatatctttgatcagtaatcctgtcattttcgatccctcctcacggaatacagcatgatttcctcgatgttcgtccggtccaccacaagctccggatatcttcttttcacaatatctctcccatgaatcagtgcttccactccataaggattccgcctgacgcccacgatacggacaccggacagcccggcgaacgcttcttccccgcatcgcagaattcccatatcctccagaagctgatctttctcctcagagaacaggatgcttccattgtggatcatcgtaatataatccgcaaccttgtcgaggtcactcgttatgtgggaggcaatcagcacggaatgctctccatcctcaataaactcaaagaagagatcgagaatctcatcccgcgccaccgggtctaatccgctggtcgcctcatccagaatcaaaagcttcggatgatggctcagtgcggccgcgatcgccagcttcatggtcattcctcttgaatattccttaacctttttcttctccggaagagcgaacctggaaagataagaggaaaacagctcctcatcccagtttttatagattcttttcataattcccgatatctgaacggcgttgagaaaatcatggaactggctttcactgaagaccacgccgatctcctctttaatatcctgctcccgctccctgatatccatgcccagaatctcgacttcacctgcgtcacgcttcacaatatccagcatggctttgattgtcgtggattttccggatccattttccccaatcagccccattatgcttcccttgggaatatccaggctgatgttatttaatgaaaaatccggatactgtttgcttaaattttgtattctgactgcatattccatagttattccctcactctccgtcatagagcatctttaatacatcgcacagttcttcacaggaaatgccgcttctcctggcaatgtccacggccttcgtcaaatactcttccgcgatccttaagttcccttcccgtatcacctccgtgtttcttgccgccacgaagctgccttttccggttatcgtctctataaacccttcctgctccagatcgttatacgccctcttcgtcgtaataacgctgatccgcagatccttagccagagttctcatactgggcagggcgtcccccgccttcagatggccgctgataatcagattctttatctgagatgtgatctgctcatatattggtttaccgctggaattgctgatgatgatattcactgcaccgcctccaaatctgttatccctatcccgcattcattgtaattattgtatatagtttatatatacactatatcatcccatcacacatctgtcaacagccatttcccgccgcagaaataaaacctaaaaatttggtaacagttcagacggcgggaaaattggtgcaaaaacggacgttgagctggctcataaggccgtctttgcaccaattttcacatcggatggatatccgatgcttcttgaccggctttttcggtcaagaagatgaaccgtctgaattgttacaaaatgcgaatagagacagaccattccccaatatattaaatcaaacggactcaggtgatgctatggataagaaaaaacaactcttccgtctggtaaaggtgctgcttttatttgccctggcctttatggccggccgattcggcgccatgatgacggatggaaaacaggcggtagaaacggcggctgacgggaactggggcttaagcttccagcaggaggggcagcccccggtggctaatgctaccgccgattacctaaagaaattcaacgcatactatgcagaaaacacaccagaaaaagtgctctatttaacgtttgacgcaggctacgagaacggcaacacccctgcgattctggacgcgttaaagaagcacaatgcaccggccaccttttttgtggttggaaactacatagagaccgcaccggatctcgtaaagcgaatggtggcggaaggccataccgtaggcaatcacacataccaccaccccgatatgtcaaaaatatcatctaaagaagcgtttgagaaagagctgggagatttagagaagctgtttactgagaccaccggacagaccatgaaaaaatactatcgtccgccccagggaaagtatagtgaaaccaatttgcagatggcaaaagacatgggatacagcacatttttctggagcctcgcctatgtagactggtaccaggataaacagccgtccaaagaggaagccttcaaaaaacttctgggacgcatccatcccggcgccgtcgtcctcctccacagcacctccagcaccaacgcccagatcctcgatgaacttctgacaaaatgggaagagatgggatatacatttaaatcactggatcagcttgtaacagaataagatgcagtaatcacacaggttttattgatgaggatacgcggacttttgcgtgagatatcgaaaaaacggaagcgtgtagccaatcatgcattacaatgacaatcctgcccgttagtaagaatcaatggtttctcgcaaaagttgagtataagggcagaccacctgtttttatagccaattcataatggatgtccaatagtatctatccacccccttgtggagccagtacacagcggactttttcacagcctggccggaaaagggagagcgggcggcagggagggaaaggtgaatgatgcagaggtcggtgggacttagggcgaacagccgccggagcaggggcaaaatcgcgttttcaggacgcagcggtaagtccccctcacatacgttcggcggaatggtttgcgggcactgagagcgaacgcatcaggcgttcggtcgaattgcccgggacccctgcggagggggctgttcgcccttagtcccaccccctcggaatccctgaacctttccctccctgccgcccgctctcccttttcctcaatcccccgcgcaaaagtccgcgtatctttacccacaaatcccccgtctcactcccctctccggcagatcacagtaaccggctccgccgctcctaactgtctgctcctggcatccggctggctcgttccgatactgaattcatagactgacgcattttccacatattctccttcggcgtttacgcactcatacgtatgggctcccagatccagttccacccgcttttcttctccaggttccagatctacccgctgaaagccgcacagactccagttctctgcccggtccggcgaatccacgggattgacatagacctcgatcacctcacgcgcgcgccggtctccggtgtttcgcgctgtgacatacgctttccttccgtccaccgctccgtcagacagctccgccttcccgtaggttaatccaaaaccaaacggatacagcggctcttcccggatgtaacggtacgttctgccctccatggaataatcctcaaacgccggcaaagcggataagtccttataaaaagtcacaggaagctttccccccggagcactcttaccgaagatcagacgtgcaaacgccgtgccgccttccgctcccggataccaggcctgaatcaccgctttggccttttcctgggccagcgataggtcgatggcgcttcccgtcatattgcagacgatcaccggtttgtcctgggccagaagttcttgcatcagcctgcgctgagaggccggaagatccagtccctctttgtccccggaggaatagctgttgccggtatcgccctcctcgccctccagcgtttcgtccagcccgacgcagagaaccaccacatcgctgtgcctcgcggcgattctcgcctccgacagccggtctcccggaagacctaaatgttccacccggtcctcaaagagatggcagccctgggcgtacagcaccgtggtcccctccgccgcttcattctgaatcccttccaggatcgtcgtatagtgggacgaggttccgtggtaatttccgatcagcgcaatccggctgtccgcgttgggaccgatcaccgcgatcttttttacagtatccagattcaaaggcagtattccgtcgtttttcagtaagaccatgctcttttcagccgcttccacagccagtctgcggtgctcttcacattccaccgtctcgtacggaattgcatcgtactctgtcgtctcgcccatgcccaacaggtaccgggtcgtaaacagcctcacaacggcctgtttaatctccgcctccgtaatcatccctttctcatacgccttcagtacgtatagatacgtatttccgcagtttaaatcacagccctttgagacggccagagctgccgattcctctgcattgtccgtcaccatgtggctctggtggaagtcacggatggcccagcagtccgatacgaaatggccctcaaatccccattttccacggagaatctcctcaatcagcagtgtgctggcacagcacggctctccctcatagcagttgtatgctcccatgacggattccacgccgccttcctgcacacaggcctcaaatgcaggcagatacgtctcccataaatcccgtttcgttgtggtggcgttaaattcatggcgaaccgcctccggcccagaatgcacggcaaaatgctttgcacaggcagctgtctttaagtgttcgccctctccctgaaggccctttacgaaagcaacgccaaggcgggaagtcagatacgggtcctctccgtaggtctcatggcctctgccccatctgggatcccgaaagatattcacatttggagtccagtaggtcagtcccttatagatgtccgtgtcgccttccttctgaaattcattgtattttgccctgccttctgtcgatacggcatccgccacactgcgcatcgtctcctcgtcaaacatggccgccagcccgatggcctgcggaaacacggtagcagtaccgcctctggccacgccgtgcagtccctcgttccaccagttgtaggccgatatctgcagcctcggtatcgcgggcgcgtcgtagcgcatctgggaggccatctcctccaccgtcatctgttccaccagttccactgctttctgccttgctttctgtctgtccataggttcctccaaattatctttattcaaaagtcttatcttagatttttcttttcaagcccgcatggctgcggtataattgcatcatgatttcaccgtttcccgtgaaaggaggatgcagtatgagccgtttaaactatacactgccggatgaataccacggcagggagttggaaggatacgtggaaaaagtagattactacttaaattccaatatccgcatctggcacaatgtccagaatgaagggtatgccctgcaccagcacagcgccatcgagattctcgttccgatcgagaacgtatacaccatcatcgtcaacaacaatacataccatctagagccgggcgatatcctctttattcccgggctcacacttcatgagatcataaagccggactggggcgagcgcttcttttttatgttcaacatggaccctttgaccagttttcacgattacagcgccctggagccggtgctgctggacccctgccttctgacgaaacgggcgaacacgggaatctacgaacatatctattccaggcttatggagatcagcaatctctatttctctcccggcgtcaccttccgggaatactcgatctatgccaatttaatcgatattctgaccacgatcggccgggaacattacgacaccctttttgccggcacggataataccgccgagaagagttacgattattaccagaaattcaacagcctcctggcctacatcaacgatcactatgccgaacatctgacgctggagaatatggccgattacacgggattttccaaatatcacttcaccaggctgttcaaacagcacacgaactcaaccttttacgattatttaagccgcaaacggatccaggcagcccagacgcttctgacgaccggcgcctcgatcacgtctatcgcatttcagacgggatttaacaactcgacgtcatttacacgatgctttaagaagtatacgaattacagccccagcgaataccgcacgaaattcatcgaggacgttccggggaatgttccggtcttctagagcgcttttatccctggccatttcgtcactgacttatccctttacgccgcccagggcgacgccggcaatgatgtattttgacagcagtaaatacacgatgatcagcggaagcaccgtcagggccaaacccagatagacagagccgtattccgtcttgtagatatcgccccggagaaggcttaccataatcggcattgtgtatttgtctttgttcgtgaggagcaccagcggtgtgaacaggttgttccagctggatacaaagctgaatatggcctgtgtggcaatcgccggtttcatgatcggcatggcgatcttattaaagatatagaactctcccgccccgtcgatccgggccgcctgcacgatttccagggacagagacggcagcatatactgcctcataaagaacaccatggccggggaagcgatcgcgggcagaatcagcatcgacagctgatttgtcatgtggatccggtataccatctggtaaaaaccaatcatcgtcacctgggccggaatcatcataaccgccatgataaagctgaaaaatggtctgcgcagccgccagtcatacaccaccagcccgtaggcagtcatagtggaaaaatacaccgcgcagcccgtggaaaatgccgagatgatcagcgagttcataaatcccaccatcgggttgaagctcttgcccagcagaatggacaggttgcgcatcatatagccggaggggatcatcgagatggcatgctgctgaatctgtgtcgttgaacgcgtggcgttgacgatcatgatccagaaaggaaggatgctcagtatggcaaggcagatgcagacaacgtaaatgacgatttttaatgcggtcgaagtacgtttcttatatttcatcagcttttcctcccttcttttaacgcttttctgtattcccgttcctgtctgcgcatctgtttattcagaagcacctcgtccttatcccgcatcaggaaaaacaggacagccgaagctgcgcagatgattacaaacataatcatgctggccgcggcggcgcggttgtacatgtagctgccgctgaacgcctgattatagatgaagacgctggtggtaagcgtggcattgtccggcccgcccattaaaaacagcttcggaatatcgaacatctgcagaccgccgattaagctggtaaccagtgtgaacagcagaatggtctttaaattcggaatggtaatatagaaaaatgtctgaatccggtttgctccatccacctctgcggattcaaaaagctccggattgattcccatgacgcctgagatcagaataatcattgtgtagccataccacatccagaactggataaattccactgttccgcgggccaccgacttgtcaaccagaaagttgatgggctcctttgaaattcccaggcgcataaagatatcgttgaccggtcccatcggatatcccagcagggcgttaaacagaatggcgatggttgcagccgtgatgatattcggcatgtagaacagcaccttaaacagcccttcccccctgatgtgataccgcttatcggtaaaccacgcagtcagcaggagcgccagaccaatctggggaacaaagttgaacagccatatatggatggtgttgctgaacgccttcttaaatgacggattggaaagcactgttttaaagttctgaaacgggtcctccaggaaattaaaatccacggcgcccattcccttaaaatccgtaaacccgatcaccccggtaaagattatgggatacagggaaaagatcagaaatccaagtacaaacggagcacagaatatgtaaccccatttcgcatatctcaatcgtttgcgtttcatagttataacctccctgtaaaatgggggaggacagaaactgccgtcctccccttgctgatgttctgtctctggtacttactccacgatgatatccaggttatcggctacctgctgtttaaagtccgtgatcgcctgctctctgctcttattaccggcagtgtattcacgcacctggccgcgccagtagttgttgatggtctcatcgtactgggttaagtttgtaccattggcgtacttgttggccggaacaaagacctcaaacatattctgaccgcctaagaaatctacggaaccgtccgatttgctcataacggtaccggaagcaaccgcatccttcgtacctgcgtcattcatggttccatttgcccacatatactgaagactgtcttctgcatcgtccagagtgatccattcgacgatatccgcaaccgcgtcttttactttggtgtctttattagccagtacccaggtgccgccccagaagaagccgatcggggaatcacagacagcccagtcaccaaatgttccttcgccaactgcagttccgccgcagtttggcgccatggtatagttgatcagccacgccggtccgaagaagccgagaatcggttttgcgccttctcccttcatatcggcaaaccatgcatcctgccagtcctgcgtgtcattgtgatagccgttgtcctttaactttttggataaatccaggaacgcctctctctttggatcgatgtttaattttccgtccacaatccagcctttgtccgagctgttttccactgcgtgccagatatctccgtcgccggatacaatgccgtagcccttgccctttagctcttctgctgcgttaaagaattgcgtccagtcgttggtgcctgcgccaagctttgcaccaatctccttcggatcatcggttccccaggtgtccttggcgatggaacggcgatagataaacgctccgccggttgcctggtagcccagcgccaccactttaccgtcaggattcgttccgatatcgactgcatactgtgcgatctcagaggatttgatcttaccatccgcgtcaattccaagatcttcatatggcgcggcatagcggctggcgtcaccctgcgtatatttcagaacaaatgcggcttccgcacagtagatatccggcgcatcactgccgcctgctgccagtgcctgatccagcgccggctggtacgcgccatcggtagtcgcaataattgttgttttaatctcataatcaaaatccggatgcagttctttgtacttttcaatcatctttggcacttcgtcggtaaacgaccagacattaattaccttggaaccggaatcggaagaagcttcggttttatccgcagttttatctgctgctttttctgtctccgcactggcagccttttctgtcgcaccaccatcggaagcaggcgcttttccacagcccgttaaggaagccgcgatcatacagccgcacaataacccagcgatcatttttttcattgtaaatcctcctttgatcatggttcgcaggctcattcgctctaagcctgcaacgtttttgatggattcattttaccatatgtaaaaggggattttctctacatatgttgcttttcatgcaacataaattgcgatgtgtccttgtgtattatgttaaatatttatttattttaatatttattttatgtatttttacccattttgtaatatgagcgcgggattaatccgtgattattcttgtttttgtttatatttgtctaattttcggtatgcgtgtataagcaatatatgaatggttaaatagctgtattcattccttataatttcaaaggcatattttgattccaatgtatttttttatttatatataatcagaaacaaggacaatatttatccctgccagcaacaaaaataaggacccggaaaagcgtaattgcctttccgagtccgtttctgatatttctcagtaaacatgtataaataaactcccaccgcccgcaccgtcatattccgttctgctcaaaccattcccggaattccagtgcgtcctccagcgtatgatgccacccaaactgcttcaaatccacccggttctcgtcgtcaacgattacgccctccgcttccagaagcttcttctgcgtatccggagttcgaaaggaagccgctccgcttagatatccggaggcgttcaccacgcggtgtgccggcagatcctttcctcccaggcggcggttcagtgcataccccacctgcctcgaattccttggcttcccgcataacagggcgatctggccataggtggccgcttttccatatggaatatgattcatgacgaatctgacacgctcataaaaatccatggtacctcttccatcatgagttgaacatctgctcgattgcggcctggggcttcacgcccacggaggtggcaaccgcctttccttccttcatcagaatcagcgccggaatgctcataatatgaaacttctcagccagctccttctgctcttccacattgacctttcccaccttgatatggggattttcctctgcaattttatctacaacaggggaaagctttttacacggcccgcaccatggcgcccagaaatcgagaagcaccggctttcctgaagttacgacttcctcatgataattattatttgtgattgaaaatacagacattttatttgtactccttttattcattgattgatgatataagaatacacgaaaacgatctgctttacagtgactttgttacacacgtaatttgttccgggtgcataccgatacatttccggacagctaccgcagactatccgccgccagctccgtgagcctcttctcattcagaagctcgattcctccgcgggtcagcttaaccaggccatctgcctgaaatgccttcagcatccgggtgataacctccctggccgtccccatgtggcgggcgatctggtcgtgggtgatagaaagcttccgggtctcatcgagcccgctctcctccagcaaaaacgccgcaagacggctgtcgatcttcttgttcagcacctggtccatcagccacatcacatcggaaaaacgcgccgccatcagctcattggtaaaattggcaaccgccgcgctgttgtccataagatctctgtagacatcgactgggatatgaagaatctccgtgtcctgctctgcttccacgattacatcgaacaggatgctcttcaccatgcagggcgctgaaaatatacataaatcccgttccagcagccggtacagtgtcagttccctgccctcctccgatatggtatagacccgcagctgtccgtccagcgtaagaattagcccggtacactcatccgctccgtggtgaagcacctgccctttttcaaaccggcgtctctgcacgcttccggccagtgtcctccgctctgcttccgtcaattttttccaaaatggaaggtattctcccaactccatgaacattccctctttctgcttccactatccattatattaccttttaccgaaaagtgacctcgtcgttgcagtcgaacaggcggaaaaattcggaatactccatacggcccgcctttaattcttctgccagcagcagaagtgtcacggagtctatcgcgccgccgcagagtccggagcgcatgtggatattttccagacgatctttaaagcctccggtaaaggatcccgacacaaaagcaaaccggtaatcagtcacgccttcatcaaataccttccaccagcggttcggattgatcttctcgttccgctccttattttcctccaaatagcggtacatctcgtccgcctgcttgatcggaagggagtatccttttccatacgccttattgtcgataatcatgccgtcttttccatagtaaatgcagacgtccggcttcctggtatctcccagtcttcctcccaggaaatccagttccctggtgagaagctccgccgtctgaatctcatagtcgcggtctgatgtaccatcgaagcccagatcgattaaaagcagatactcgtggcttacatgggccagccgctctctgacgctgtcctttacgacagccatatcggattttacagagatccggcccgcatcgtccgccggaatctccaggcctacgatatcgtccatgatcttatacgtctttccggtacgcttcacatttaagccgatgttctcaaaaccacggatatcatccttaatggtctccaccgtctcttccagtcccgccgtctccagataagccttcacctgctccggcgaacgataatccttcagaaggtactggataatgcgggtcctccggttccttaagtaatcccggtctgctgccttcgttgccagcatatcccacatcacccgcttcggtatccgggcaaacttcgagacaccggtggtatgcttgaacacggttctcccctttaacgtaagccggtaggactggggtatggttccctcataccgcctggttccagcatcctctgccgccgtcttcgccgcctgttccacccagcccatctgtttcagccagctgcagatggttcggacgtatttatcactggttccctctgtatcctgaagaagctttgccctgtcctcctccgccgtttcggagagtccctgcaggatcatatgctgcggaatcgaggtaaaaccggcctcaccgataaagcccagtttggctcctatttcaaactttgtcagatggtcgcccgctgccagcagcgaaagcacccggcagacaggaggataggagagaaacgccgttgtaagcgcctcctcctcttctttgctccctgcttccgcctccgcataggaacgtcccagagcggacagtgaacaggtatcgccatttctgtcataattcaaaaaaccgatgctgaccgcccagcgcagaaatgaatccgccggccagtcactctggtactcttttctctgcccgggcagcaccgcctggatgatgccagaacacggtgcattacttctcgtatatcccttcggtgtccctttccctttcagatgggcgtacggcacgatgaccggatcagcctccagctcctctataaattccgctttgccatcttcatctgaaatgagccggaccagtttgtcctctattaaccgtctgttgacgggagaccccggcacaaagaccgataccacattttttaaattttccagcttataagcctcctgtacccagccaaatgttctgacagccactcggaacacctccttttcatctttcatctagcttctagcttctttcgtccaatagctttcatcttcgtctgcattacccagcaccgagaactccgccgccttctccgcatgaatcagggccgtatcaaacagctgcacatccgtgtccccgtcctttaccagaaggccgatctctgtacagccaaggatcactccctgggcgcccctctcttttaaatgggcgatgatcgttaaatatgcctcttttgatgtctcagacacgataccccggcacagctcctcgtagatcacccggttcacggtttcgatctctgccgcctccggaatgagcacctccacgccgtactccgccagttttcccttatagaaatcctgagtcatggtatatttcgttcccaaaaggcccacacggtccatgttctctgccttaagcctcagagcggccgcctccgcaatatgcaaaatgggaatatcgatcttactctgaatctgaggcgctaccttgtgcatggtattcgtgcagattacgataaaatcagcccccgccttctgcaggcttttggctgcctctcccagtatttctccgcttctctcccattctcccgcggcctggcactcttcgatctcctgaaaatccacgctgtaaagaacgcatctggcggagtggagacctcccagcctctctttcaccgcctcattgataacctgataataagtaacggtgctttcccaactcattccgccgatcaggccgattgtcttcatctcttctcttcctccattttctggcacgacggacagtaatagaccgccccgcccagataattttctttgacgatctctccgccgcatgcgggacagccggaagcccatgtattctttgacatcaacgtctgatagccccctggattcccgaagagatctttttcggtatcgcgcccgccctgttccgtcatggtttgaagcaccgtctttacctgtgcccacagaacgttcttttcacagtctgaaaggctggaaaccttgcgtttcggatgaattcccgcctgaaacaggatatcctgaaggcagccgttgccaagccccggcatccgctgctccgtagccagaaatgccttgacgctcatggccggtttcacagaagccagcagttctttaaagtacccttcatcaaattcctccgtcagcggcgaaatgctctcgatactctttctgtagtactcattgtcataatctcccgaatggcaggaaatactgccatacatggccactgtaaatacaatcgcggacccatccgtaaattccaggagaagctggtatttcttcggacggacctcttccttccggataaaacggggatttactccgtcattgaaacacagcctgacgccgccgtcgaattccagttccgaaaagataccaaaaccagccgcgccagttaccgtatgaccggccagaagcgcctgatactcctccggctcatggttaaaccagcagaatttgtggggtgaggaagggggatataccgcggataccgtctttcctctcactgtctctctcatctgttttgccaggtttatggcctccggcagttcaatcatcgcgtgtcctccattctgacggccttaaaccgttccttcagcagtccctttatatattcggtatcataagtcaaaatctcctgtttctcatctctggtgttatatgcttttaaaattatattcccattctgaaaatcggaaaactcgatatcgtcgtaaatatcataatcccgatccattagttcgtgaccatttattccctccggctctgtaaaaggattctcaaagtcgagaatcatgacatcaaatgggcaggcccagaaacagcctgtcactgccaaaaggccggatttactgtcatatactgcatctgtccagataaaactctcctgaaagtcttcctgtttatccggataaacacatgccggtacataacggaacacctctcccgtctccacacagaaaatactgcatccgtataaatcctcccggaataccagataccgcttcccattccggtggtgaatcagccggcagaaatccccgtcatcatccaggttcctccagcttaacagtacggttccgtcctctcccacaagatcatggatcaccgcgtggatattcccctttaacgttcctgtataatatcgggagcacaaagagaaaccatcgtctaaagccgctgtttccggtattcccttctgctcttctctgtgttcctcattgaatatggaagagaaagattcccgatagtgaaggtaggcttcgttgtaagccgcgttcatctgcctcacatccttttctgattggctgtcttgcatttttctatgtatttttatattctatcataaacacgaaattcgcgaaagtcctcatgaaaggtttcgatctgtatctgttccggcatgcatgtccgccaaacctgaaatgcgtgctgtatcaaggccgctccagattgacaagcttcgtgtaatattatacactgtccataacatcatgcttttatatcagacaaataaagtcttagcaaaacggattcagaagggaaggacaatggacaaaaacaatattccggttattacgtgtatgtgttccggtatgacaatcgggcttgccatcggtggtgcggttggcctggcacagggaagagcaggcataacaatgtgttatggcttattatttgggatgattattggagtgataataggaactgtcattaagaaagtcaaagaaaaagaataacacttgtaatgtggctttgctttactctgctttgtgtcatttatggaattatatccaacaatccttatgagataaccttaatacctgaagtaatctttttcttactgttcttctttgttaattttattgaatacttatggaagaaccggaaaaagcagcggctaataaatggatcattatgcatggaggtatatgatgaagcatgaaacagagggtctgcatgaacaaaaagacagaacagagcaagtctcccaatttcagagagcatgcagtcagatctgtacctgctgccagctcccttccagcggacattttacagttggaaagatttatgcattcaaatatatcattgatgcacagcaagtcatggatgaggaggaggaatgggttactctgtgcgatcaagcattcgattcttgttttgaagatattacggaagtgactacttctttctgcccattgtcttttgacaaaacgatataccatatatatctgattttggacgaagacagcaataatcgcaaggagataaaagcctgcgccaaagtcctgaatatcaactatcttaagacaagagaaaaattgaatcacaaacggtgtttgcttacaagcggggaagccggtatgatacagggagtgctggagaaattatctgcttttgatgtacactatgaaatcgaacctccttatccttattaacaaacaccccgataaagccccatgcccatgcccttgccctctactctcactcaaacaatgacatctgaacccccgcctgtttatcctcaaaggtatgcatatactcaaacagccgattgctgctgcagaccattcccgtattacggcattcttcttttaccagggcgagcagacgcctggtatccggcgacgggatctcatagctgtttccataggtacggatatagcgctccttcatccccggaaaatgctgatccagctgcgcatagaaatactgcctgtccccatcccgcagcgtcacgccgatgccaaagagcatcagcccgtataccgacgcgtcacggcagtatgacagaatgccgcgtatgttctcctctgtatcgtttataaatggaagaatcggagacagccagacgatggttggaatcccctcctccttaagaatccgcagcacctccgctctgcgtccggttgtgcagacattcggctcgatgatccggcaaagtgcctcatcatacgtcgtaagcgtcatggaaaccacacacttcgtcttccggttgatgctttttaataaatccaggtcgcgcaggattaaatccgatttcgtctggatggacaggccaaatccatagtaatcgatcagttccagactccgccgggtaagacagagccgcttttccagatgtaaataggggtcgctcatagcgcctgttccgatcatacatttctttcgtttgctcttaagcgccttctccaacagttctgcagcgttggactttacttcaatatcttcaaacgcatgatccatctgataacaggtgcttctggcgtcgcagtatatgcatccgtgcgtgcagcctctgtaaagattcatgccgttctgtgcagacagaatcgactttacctgtttttcatgcatacagtttcctcctgatttccatttccatttccatttcaaaatcgaatataatcgaactgtaactacaataccacactaatcacgtcatctgtatgtcatgtttattcatttctccgctgtccgccggcaattatttttatacaaaaaaacggcatcgaagcaggaagcagcagaggatatcatatctctctgctgtgtgtcctgctccgatgccgtgagggttaaacgccccgcaggcagagcccgccccgcttgatcgggtacagtacctgcctcaccgctctctggaataacggtcgctgttcatccactcctcagccaatatggttcgccacctcaaacgcatcccatatcgcatacataatattggataccttccttgcgtctcccagcagatacagctccggtacgtcaaattccagctggcggtacagagagtcctcctcctgataccccactgcaagaattacactgtcacaggcgatttcccgttcttctccgccgcaggaagcatgcagaattccgccgcgatacccggtcactctggcggaggttatggccttcactccgtgatagggaagcaggcgttccagcatgtccttgttggcatggcacaaggggccgttgaccgccatcagccggtcgagagtttccacgatcgtcacgtttttcccctgttctgccagccagagcgcagtttcacagccgaccagaccgccgcctacgaccacggtggtatctccgcagtccttttccccggtcaggacctgagccgcaggatatacccgctcgtcatcacccagggaaaataccttaggcctggagccggcagcaatgataaccgcatcataatttcccgccagaaccatgtcccggtccacacaggtatggaaatgtaccggaactttgaggttctgaagctgaacctcataccagtgcgccagtgcgagatcgtcctccttaaagtcaggagctcctcctggaatcaggttgccgcccagcctgtcgcccttttcgaacagctccggcttatggcctctcaccgccagcactctggcggcctcacagcctgccgcgccgccgcccacgaccatcacccgtctgctctttaggatgggttcataggcggtcacccgctccctggcagcctgcgggttcaccgcgcagttaatcatggaaaattcctgaacacggcccatgcagccttcctgacaggagatacacggacggatctgttcccattttccggcccttagcttattcacatagtcgggatcggccagaagcgggcggccaaggctgacgatgtcgcactctccggcctccacagcctcggaggccatctccggattgtccatacggcctgcgcacagcaccgggacatccacagcctctttcaccatcttgcagtacggacggaaaagcccctttttctgatacatcggcggatggttccaccaccatgcgtcatacgttcccacatcggtgtccagcgcatcatagccgtactgcaccagcagcttcgcagtctccaggccctcctcgatatcgcggcccttctcctcaaatatttctcccggcagagcgccttcccgccagtccttaatcatactctttaagctgaaacgcagcaccacgggaaaatcctgtccgcaccgggacttgatctcttccaccacttcccgggcgaaccgcagcctgttttccagtgatcccccatactcgtctgtcctctggttgaacatggaaatggcaaactggtccagcagatagccctcgtgaaccgcatgaatctccacgccgtcaaaaccgccccttttcgcatgatacgccccgtctccgaatgactttacaatgctgtggatctcctccctcgtaagcggcctgcagattttatccagccaccggtgcggaatcgcggacggagcgaccggcggaaactctccgagattcgtcggtattgtcacccttccgaagccggccgacatcatgagaaatatcttgcttccgtaggcatgaacccgctccgtcatctccttcgacgtccggataaaatgaaccggattgtacgtggaattggggcagtttggcatactctgtgtctcaacctcacagtccgaaaaggttactcccgtgatgatcagacctgtgccgcccttggcgcgttccgtgtaatagtcgattcccctctgattaaagccgccctcggcgtcagccagtcccagcggacccatgggggccagggcaaaacggtttttcaatgtgaccgatcctattttgaccggtgtaaacagattcttgtacttcatggcaccctcctgttatttttataacgatattataccgttccatacagggcaggcgctatcaacaattgcttgatggatgtcaataatttttttattcctccgggaaatccgcagactagtacagcattgcgtaggtttcggtgaattgtgtgcttgatatttgcgtcaggggcgcgtccgcgaagcgacggcgtagaggaccctacggttagcttcgcgggcgtggtcctggcgtgaatagcgagtgcagaattcactggaacttatgcagcgctgtattagctccgcagaaaatcctccagcgcccggatcaccgaataccagccgttattctccttataaacgccgtacacttcccatctcagcctctccctgaagggaatggccctcatatggtccatacggaaatgctccgcggcaaaatcaggcaccaccgcaagccccgtcttctgcctgcacagctggtactgaaagtttgcatctgcggttttggcagcaataagcggcttaaatcccctgacctcgcaggcctccagaaaatcgtggtacatatgaaagtactcgttcatcaggatcagcttttcaccacggaccatatcaatggtgacctcttccagatcatagaaggggtggccttcgtaaaccagaagacagactctgcatccggccagacgcctgttttttacgccgtcttccttccacgctccaacgacgaaaccgtattcgatggtggaatccttcagccgctccttcacctcctgattcgagtactcacaccattccacggaaatctcaggattctcatcgataaatttctgaatcaccggaaaagaaagtacgttaaatactccgcaggcacagccaatgcggagcagtcgtttttcatttttcagctgctggataccgttgcggatttcctcgaactcccgaatcaggatacccgccctctcatggagcagttctgcgctctccgtcggcctcacaccctgtttcgtccgttcaaagagcaccgtatccagctcgctctccagcatcttaatattgcggctcaggccctgaggcgtgataaacagcttctgtgccgcctggttgatgccgcgttcctcatagaccgcctcaaagctttttaaatccttgacattcataccattctcccgggagccgtaatccctataccccgtttcgggcgcagatatccttcaggcagcatttttcacagaatggcttcgtcctggctgtacagacatctctgccatggaatacgaggcggtgacagaaatcactgccctcctccggcggaatcagcttccacaaagccatctccacctttttcgggtcctttaaatcctccaccagtcccatacggtttaccagacggatacagtgggtatcagtgacgatggccggtttgccgaacacatcgcccataatcaggttcgcgctctttctccccactccgggaagctttaagagtgcatcgaaatcgtcgggaactctgccgtcatactgttccttcaggatcttcatgcacgcgctgatatcctttgctttgctgtgccccaggccgcagggcttcacaatcttttcgatgtcttccacttcggcccctgccagcgcctccacgtccggatactctgcatataaatcctgtacaaccacatttaccctggcatcggtacactgggccgccaggcgcacgctcacaaggagcttccaggcctcatcgtaatccagtgtacaaccaacgtcagggtattcttcttttaggcgcctgatgatttcaagcgcaagcttttcttttgtcatagccgtctcctccaatcctgtaatcatattatcattgattggggaagacggcaagtggcagtgcatcgtttacagcatctggctgaactcaaccttttcccggttcggtcccagaatggtgaaaaagcggacgccatttgcccagaagggcagaaactggatctcctcgtcaagcatggggtatcccgcttctttgatctctgcaaatactgcttcaatatccgtcacatcgagagccacgtgatccaccgcaccgttcctctccgccgcctgatggttctcatacgtctcgatcacaagactgccgcatctcaaaaaagcaactctctccccagccgcttcatttaccgtttcaaatgccgtctcaaaccccagttcatggtaaaatgccaccgtcttctctatatcattcgtcgggatgccaatatgctggagtcccgttatgtactgtgctgccattttatcttcctctcccctgtatcatgatccacagctccgtctattcttccgcgttacgattctgccacattgataatcaccttcatggtgctctcccggttctcatcaatataccggtatgcctccagatattccctgaatgcgaaatgtttggagatcagcggcgccagcaccacctttttttcctttaccagacggatcgcatcgagatagtcctcatttcggtacatcatactggtattcaagtccagctcatggtcatttaagacagccagatcaatctgggcggttcccgcaaataccgccaccaggatgatggtgcttcccttgcgcgcatattgaatggcctgtcccatcgtaatattattgcccgcgcagtcgtaaatgacgtcagccttatccggcccgaaattctccaccatggcctcaccgaaattcttcgtcttcgtattgatgcagaaatccgcgccgcattccttcgccttttccagcctcaaatcgctgacatccgtaatcatgacgctctccgcccccagacccttcgccgtctgggccaccaggattccgatcggtcccgctcccaggactgcgatcttagcgccttccacgtttccggcacgcttcaccgcgtgaaccgccaccgccaatggttcaatcatggcgccctcgtcaaagctcatctcctccggaagcggcgtcaccttggccgcgtcgacagcgaagtaatcggatgccacaccggtcgtctgaaatcccattaccttcagttcttcgcagagattgtatttgccatgacggcacggataacattttccgcagaccacctgcggctggatcgtcaccttctgccccgccttccatccttttacaccgcttccgagcttctcgatctcccccgatacttcgtgtccctgagtgaccggatagctggtaaacggatgctcgccatggtagacatggatgtccgatccgcacacgccgatctttctgatcttaaccagtacctgattctcttccggctccggaaccggcacctcccgaaactcaatttcccccggagcagtcattacctgctgcagcatcatacatgtaccctctttctacattttggtttgtgcaataatataaatacttttatatatctttttattaaagtatttatattattgcacaaaccagggaacttgtcaatcctgtatgtcaccttaaatctgctatttgtttataaatataatccggctcaccggacagaaagcagtccagacccaattcttcttttgccaggatgcggatattcatagtctaaacgattacttagttcagtttacaaggaactacacgcagaccgtgaaacgggggctgctgacaacaaataaaggctgagtatcaagcaccggaaaagtgcgagatattcagcctgttttgttgtccggggtttccaaaggggcttgccccttggcacacgactttgcttgcaaagtgtagtgtgttatacgctctgtcggcgttgccgtgaaaatgccgttgcagccggagagggcaagggcatttgaagcggcaggaaaacagggttgtgattgcgtggcgtgaagccacaagcgcagaactggtttcgtcagcagacagggcgtatatgaaagcccccgtccctcgtccggtgccggactatggaacaaagtatcccatagtgtgtccatacttttgaaaagcaagcgtacttttcaatctttgccttttttgaaagaaccgctgccgcgatatgtgttgaccacacaggtaaagacctgcccacattgtttgcaccgtatcatgtgaaccatgatttcatccgcccagccgtccccagtctttacctgattcagcgggcatgtagattcctccgcaagcagttcaaagccgccatttgccacaagctggcggatatattcgatacaggccagataatctctcggtgcgttaaatttcttccatatctgaatgctatggcagtagtcacacatggcagttccctccttacgaaaacacctgctaacatcgttttcaagttttttcgtattgaaattttctcctaaatcttgaatgggcggggagccattttagggctttcccgccttgattgcccatcagcaaagaccaggcgcgactgtcaacggcggcgcatttatgtgacgttcatcttgtcgttgactggctcggctggatttgctatttccccgataaactggaatttgcttatccatagactatcttttttcttttatttctggaagaataatctcttttccctctttttccattcgctttataaagttatcaaagtgatctgtcatgccatcaacaaaaaatgcttttctctttcttccattgacatacacattcataccaccacgtttcattttacaatatgatatatctgatattttccagtgtcttttaaacaaaaatgccttgataacagtcacatcatttccatctacacaaatatcccacactccttttaacggagcaatcatacccaaaaaagtaactccaaaccaaataatagaaaatggaataatgatcaccaaacatcttttagagcaaaaagtttcagggtcactccaaaaacaccagataaaagcaacaagtacaaacaaagcacctattgcacatataaatgatacatcggttattgttcttaccgtaaatttttttaaagattgtgttcgcttatgatttcttctttgcatgatatctaagacgaataaaacaatatataccgttataataccacctatatatttcataaaatatcacctcacaaattccagtttatcgttctctacttccgtccccgctgaggattcggatttttcagcaaatccgacttctgtgcaatctttttcagccacttcttttcctcgtctgacagcttcttcaaattcagtttgagccgattgcagataaacaccagagcggcttgctccgggtcgctgtcctccttggcggtttcttcaatcgtctgcaagaaatcttccagcgggttgtcctccgggacactgaaaaaatcctccttatgggcttcccgcaggtcaagggctatgccgtttatgtcccgctgtatcacatagcggcaaaactcgtcctcgtcaagatgggcggcgataagctgtctcaactgtgggtctgtcaaaccgggattgtgctgcttcataatcgttgcgctcatggtgtccactatggcatttgcactctgaacctgtttgcctgctatgccgttcacatagatttcaaggtcagccatcagccgtggaaaatccgggtgtactgccagctcacacaagagggaattatccacccgcccacttttcaatagttcaatcatagcatcactcaaatgcaggtctgcaagatcggcgtttgggtgattttttgtgtgagaacggcacagcagataatcaacggacacttcataaaactttgccaactgaataagggcatagtggctgatgtccttgaaattatccccctcataactgcccaacgcagacttggagaggtgcgtctgctccgcaagctgttccagcgtcagcccacgctccacacgcaggtctttcaatcgttcttgtatggatagttccatgctccccctcctcgcactataaactgcaatttttctttttagaatgaattatttattttctacaatagcaccatatttcgtatgcggaagatattgtacctttaaataagtatttttatcaacataccttgaaaatactgtgatttcgatttcatcatctttaactttatcatatagaaagatacttcttctttcagaagatatatctgcaccaccatgagattgttcagttacatatccttctgcataactatactgtttgtttatgatgtaaggcatatctaaaacaaaatctttcaaatataagattaaaagaatagctactataacaagaacggtattagccaatcgaagaaatattatatcatttttttcagtatattctttttttatcgcttctttatcaaaaaatatcgaatagataagttttctttttttaattagatagacaatgcaagcaattaaagctataagaaataatgaaactcttataaacaatctaaatatagcaaaatccataatatcattcccttaaacttctaatttgttgttccgttgtttccattttaccacaattccgagagcgtggaaatagagagtttttcgggctgatttccgaccttatggatatacggagcaggcggtcttttaggtgtagacttagggtggttcatcgatgatctgcaacttgaaaaatgaatgaccgtccgaaaaggaatacctctcccggaaaagtagcgcatttgcgtaccaaaggagaaccacgccgcagaaatggggcaggaagccttttcggggagaacggcaaaggaaaaatggagggaacacatgaaagagaacccatataaacgactgccgcccatagagcgcaagcaggacggctccctttacctcatgacaccggcacagaggaaacaggcaaacgccctgatccgccgggagtgctgcaattatgaggacgggaactgtatgctccttgacgatggggacactcacacctgcccccaggccatttctttctctgtctgctgtaagtggttccgctggtcggttttgccgcaaatcgggacactggaaacagagatttaccgggtcagggatttgaaacgctgtgcggtctgcggcagggtgttcgtaccaaagtccaaccgggcgaaatactgtcccgactgtgccgccggagttcacaggcggcagaaaacagaaagtgaacggaaaaggaggtattgtgtggacagttaggggctgaaaagtccttgatttacaaggctttgcaagcacaggacaggggcaggcaatagaaactatcgtctgcccctggaaacgggcttctaaccgtccacaaaacacgatatgacaaacaccatttatatccatcagccggaaaaagcagtcagctttacccggcttcccaatttcctttttgaagcccccacattcacgcccctgtccaacgaagcaaaggtgctgtatgcctttatcctgcgcaggacagacctatccagaaaaaacgggtgggcggacgaatacgggcgggtttacctctactatcccatcaacgagttggtagagctgctgcgttgcgggcggcagaaagcggtcaataccctacgggaattgcagtatgccggactggtggaaatccagaaacagggctgtggaaaacccaaccgcatttacccaaaatcctacgaagcggttccaaacaccgacttcaagaaatccggctatggaacgccggaggactgaaaaccgcactccacaagtacgataatcaatcctcttgaagtacgaaaaccggacggtatatagaaatacagagattaaaacgattttatttatatcttatccattcctatcatatctgagatattttctgcgggattttcctgtggaaaagtcccggaaaggaacggaatgaggaaaggagtttcatggcacaacacgcaattttgcgatttgaaaaacacaagggcaatccggcaagaccgctggaagcccatcacgaacggcaaaaggaacagtacgccagcaatcccgacattgacaccagccggagcaagtacaatttccacatcgttaagccggagggcaggtactaccattttatccagaaccgtattgaacaggctggttgccgcacccgcagggatagcacccggtttgtagatacgctcataaccgccagcccggaattttttaagaagaagtccccaaaagagatacaggaatttttccagagggcggctgatttcttaatcgggcgggtaggcaaagaaaatatcgtgtcagcggtggtacacatggacgagaaaacgccccacctgcatttggtctttgtcccgctgacagaggacaaccgcctgtgtgcaaaggagattatcgggaacagagccaatttgacgaagtggcaggacgattttcacgcctatatggtggagaaatatcccaacttggagcgtggggaaagcgccagcaagacaggcagaaagcatatccctacccgtctattcaaacaggcggtcactctctccaaacaggcaagagccattgaagccacactggacggtattaccccattcaattccggaaagaagaaagaggaagtcctctccctgctgaaaaagtggtttccccagatggagaacttctccgggcagctcaaaaaatacaaggtcacgatcaatgacctgctggcagaaaatgaaatgctggaggaacgagccagagccagcgaaaaggacaagatgaaaggcacaatggaacgggcaaagctggaaagcgagctgcacgacattcagcggctggttgaccgtatcccgccggaagtgctggcagaattgaaacgccagcagcggcacacaagggaacggtgatgaatgacagaaaacatttcacgccgcagcatggcggcactttgaaaattaaatacggaggtactatggagcatatcagatacaagaaagaaaccgaagtcgtgacttttcagggaaaggaaatcacgctggaaaatctctccccggtgttcacgccggagctggaagcggcaaaacgccgggagctggaacagcagctttatgaggtgttccgcaagtatgccgacaaacggcagagtgaggaagccggggcataaggttttccgaatccatcgttgatttgcggggctgctgacggtataataaaggtgtcagcagctccgtttcttttttttagaaaaggagcgacaatatgaataatcgaatagacgcaatctatgcaagacaatcggtggacaaaaaggacagcatttccattgaaagccagattgaattttgcaaatacgagttgaaaggcggtaactgcaaggaatacacagacaaggggtatagcggcaagaacacagatcgtccaaagtttcaagaactggtgcgggacatcaagcgggacttgattgcaaaagtcgtggtttacaagctcgaccgtatcagccgttccattctggactttgccaatatgatggagctgttccaacagtacaatgtagagtttgtgtcctctacggaaaagtttgatacctccaccccgatggggcgggcgatgttaaatatctgtatcgtgttcgcccagcttgagagggaaaccatacagaagcgagtaacggacgcttactattcccgcagccagcgaggtttcaagatgggtgggaaagccccttacggcttccatacagagccgattaagatggacggtatcaacacaaaaaagctggtggtaaatccagacgaagcggcaaatatccggctgatgtttgagatgtacgcccagcccaccacctcctacggggacattacccggtactttgcggaacaggggattttgttccatggcaaagaattgatacgccccacgctggcgcagatgttacgcaatcccgtttatgtgcaggcggacttagatgtgtacgaatttttcaaaagccaggggacggccattgtcaatgacgccgccgactttacgggaatgaacgggtgttatctgtatcagggacgggacgtgaagcccagcaagaagaacgacttgaaagaccaaatgctggtgctggctccccatgagggcattgtcccctctgacatctggctggcatgccgcaagaagctgatgaacaacatgaaaatccagtctgcccggaaagccacccacacatggctggcagggaaaattaaatgtggaaactgcgggtatgctcttatgagcatcgtcaaccgggtaggccgtcaatatctccgctgcacaaagcggctggacaacaagagctgtgccgggtgcgggacaatcatcacttcggaactggaagcggttgtttatcagcagatggtaaaaaagcttgacagatacaagacgctgacaggcagaaagaaagcggcaaaggcaaacccgaaaatcgccgccctgcaagtggagcttgcccatgtggacagcgagattgaaaagctggtggacagtctgacgggggcaaataatgtcctgctctcctatgtgaatgtgaagatagcagaactggacgggcgcaagcaggaacttctggcgaggatagcagaactgacggtgaaagccattagcccggaacaggtcagccagatttccggctacctcgacacttgggagaatgtatcctttgacgacaagcggcgggtggtggatttgatgattaccaccatagccgccacaagcgacagcttgaatatcacatggaaaatctgacgggtggaacccctcccgtcagatacctactctgtgtagtcccttgtaaactgtactttacagacgcataaatcccctgtgccattaccatttagtaaagtcacaggggatttgattttcacttatacaggattcgatactccgtcctttttcaacagcctgtccgtaaaatgtttcaatccacgctcgataatttcacagagtgcgactacatcttgtagatgcacggcctgacttcatgtcagcgggggataccgatttctctccgcccaccactgacgttaagcttgtttttggcgtttcatccctccacctgtagaggtgaggaaattcttgcttgttttgttaaagaactgcacaaaaggcccaagtcccaaagcggataccagcgttcccaggccgacaattccgcctgccgcgaagcacaccaccgcacagaacacgtcacaggccatacggcaccagaagtaggagatctttttctgctttctgcacataatcagcgcaaggctgtcatacggcgccacacccacatcggaggtctggtataaagagagcccgaaactgcagaccaccactccgattaatacggtcaatagcttctgccacagcatggaaggcattccaagagtcacctcccatattccgaaaaagaaggtaacgatgtatcccagaagcagcgcgttcacagccgtgcccaggccgatcagctgccggcccatggtaatctcagcaatgaaaatcacaagattcaccaggataaggaaaaacgcatactgaatgccggtgcagtccgacagggccattaccatgccgctgaaggggtcgttgcccagtcctgaaagtttgaaaatgctgattcccattcccgtaaaaatattaccgatgatcatgatgacggcccgcctgcggtccagtttcttaaagtaatctcttatcattttatgaaggggtcctttctcctcagtttgcgcgtttcgcggctggtttttcatgcctgcaccgccaaaaactgcgctcctgccccatcataccatccttttccagaacatgccataacaacctttaaaaatttacggcgttctcactcaattgcctggccgcagcagcagcttcttacaccgcctgcggagtctcatcctccagaatcttagaaagcgccgttccgctgctggtatggcagcggaccacgcgggtggcgccgtcatcgatgccgtccagggcacattttaccatcttgtgggaaaccgtgttggtaaacaggaccagcaggtccggacatccgatcttcttatccatgttggtgctcatctgggtaaagacctttgccttgcatttgaattccttgcatatcttcttgtactggctcaccatacggtcgtggccgccgataatcactacgctcatttataatacctccagttctctatcgtgctgtctgtaattcacagcctgccgggttttacaccattactgtttcctccggctcttcagtttatttggttagttatgtctaactacattttaccagctattacaacatttgtccatagccgttcttgagaacatttcttaatagatgggaaatggaaaaaagagtcacaccgcttttcgtggtatgactcttttaaaccgttttctattgtttctgttccagtaaattggtcatgcttttcagactgaccatgagcgtcgatgtattatgaagcagcgcggaagtagccggcgccaggattccgttgacgcccagcaggatcaggcccaagttaaatccgatcacaaaccggtaatttctgtttacacggaccatcagcgcgttgctgattcgtttcagtgtcaccagttgatccagtgcgtcctccgaaatggtgatatccgcgatttccctggcaatctccgccccctcgctgatggcgattcccacatcggcggctgataaggcaggggaatcgttgataccgtcaccgaccatgatgactttcctccctgcggctctctctgcctccacgaaactggccttgtcctccggaagtacttcggagtaatactcgtccacgcccaccttctgcgcgatggcctttgcagtcctgtcactgtctcccgtcattataacgatcttggagagtcccagtgctctcagctgactgaccactgaggcggcctcctcccgcaggggatcgataatgcagatcaccgcagcgaggcgccctccaaccgccatgtagagatgggaatactccggcggaaggctctcgtactgttctcttccgtcttccggaatcacgctcccctcatcctcgaagacaaagtggtgactgccgataatcacccgttcccctccgatataggaggcgattccatgggctacaatatagtccaccttcgagtgcatttcctcgtggattaaacctctccggacggactcctgaatgaccgcgttcgccatggaatgggggaaatgttcctccaggcaggctgcaatccggagcatctcatcctcgtcccgcccctcgaaggtcacgacgccggccaccaccggcctggccttcgtgagagtaccagtcttatcaaatacgatggtatctgcctccgccacggactccagatagacgccgcctttgactgtaacccggtagcttcccgcctcccgcatggcggaaagcacggacagcggcatggccagcttcagcgcacaggagaagtctaccatcaggatcgagatcgccttcgtcacattccgtgtgagcagccaggtgagcaccgtgccgcccagactccagggaaccagtgcatcggccatggcggccgcctttccttccacattggatttcagcttctcggagtcctcaatcatcttgacgatccgctcgaatctggtggatccggccgccttcttcacacagatagtgatgctcccttcctccactgcggttcccgcgtatacgtatgtatccggttccttcttcaccggtatggattcaccggtcatggaggcctgattaaccatggcttcgccggtcacgacaattccgtccagcggaatcacgctgcccacatgtactgtcacgaggtctccctcgcggattcgggagaccggaaccagaacctccgtaccgtccacattctgccataccttctcgatgttcagggacatgcttctcgccagatctcccaccgatttcttgtgggtccattcctccaaaagctccccgatccccagcagaaacatcacggaaccggccgtattgaaatccagtcttgcgatcgacaccgtgatagcggtggcatccagaacctcaaccgtcagctttcccttcaggagacagcgaaggccctttacgatatagccagcggacttcaccgccgtatacacagcccgaaacggcacaggcagaaatacctttgtaaacgccctcacaacgacccgctggatcagtttttccttgtattcccggttcagcgcccggccgctgtccttcgggaccagctcacagagtgactcgtcctgaaaggaaaaacgcctgatctccccgatgatgaccgaccgcaggccgtcctcatagagaattgccgcatccgcggtcctctcatagaccttcacctccttcacacccggaatgaggctcagggcacagcagaacagatccgcctctctcagagtcagctgacgccggtcgagatggatccgaagccgaccctttatctcgtgtttcactataaatctcatgtctttgtctcctgtcctgtgtttctacagctcttcaaaaaggaacgcctgaggaaaattccatcaggcggtctctgaaaccatctcttcgctctcgtcttcaaaggcttcatccgctctctggcggttgatctccttcgccccagccagaatatcgtctgcgttctcctggatcgaagtggcagttgtcatcacacagtccttcgcgcgcagtccggcggccagacagttgacgtaaaacttcttcgcatctttactcgccagaattttaacgccggctgtaccgaataaaacacctcctgcaaagattccgatttttttcattttgaagcagtccaacatttctttatcctcctgtttttcttatttatgcttgtaacccgtataaaaaaccattgccaggcagaacagcattgcccaggcccaaaacctgtgttttttcatcttcagtcactccttatataaacgttttactagaaatttacccggttagtcaacgccaacagaccttattgagaaattgagtcatttaccggtgtgatccggtaaacagtgtatcccgcgtccttgacagtctcctttaacacggcgtcgctaagctcctgtttcatgcggacatctgtctccgcctccattaaattcacgcgggcatagacgccctccagggaatttaatgcattctccacccggatcgcgcagttgccgcaggacatcccgtccaccttcaaaacccggcggtgcggatagtgggtgagatccttatcacttacctttattttcttcaccgcagcctcgcccgaacctccgcagcagccggtggtcagcctctttctgtagcttcttatcgccagaacccctgccatgataagggccaggcatataatcgctgtcgccatatgtgctccttcctttcttccaatttcttctattagttgtaactaactatagattagtacctgctaactgaattgtcaataatttttttcatattcttattttgacctttttccccggctatgataaactatttgtatcacgcattctgatactttaaccgcagggaggtaaacgaacattgaagatgaacgaatcatccgaaaactatcttgaaaccatactgattcttagcaatagaaagccgcacgtccgttccatcgatatcgccaatgaactggatttctccaagccgagtgtcagcgtcgccatgcgcaacctccgcgaaaatggttatattctggtggatcaggatggctatatcaccctgacagattccgggaaacaggttgctgagaccatgtatgagcgccatacgatgctttccaactggctgatgtatctgggagtcgatgaaaaaaccgcggcggaagacgcctgccggatcgagcatgtggtgagtgcaaaaagctttcaggctatcaaggatcacgtgacaaaaggaaatgaattgctggaaaaataggaaaacaggcggtccggggagaaaccttttctctgcagaccgcctgtttttctgttagtttgtattctgttccgtttcctgctaaagccggctcatacctgaatccgtctcgccacatcttcaccgatcgcaaggcgcacgttatcccgtccgataatgattccgtcttttccctgctggaaaacacggatatcgcttccctctctgatcccgtatccgtttagaaattccagaatctggggagcaccgaacatccatttgatcgtatagtcgtctcccgcctttgcctgtgccagtgactgcatagctgcacccccatttccacatcactcgctgcgttttttcgttctatgcgctttgaaactatccgcctcttcttactcctagtgtaaccattttggcgtcggttagtcaatggcaatgcgggttaggcacttttaatctttttatatttgacgggaaagtccgtcgatgctccagcctgccgctttttcgcggatatccacgtaatctctgtagattcccttctccttcatcagcgcttcatgcgttcctctctgcaccacgcggccatcgtcgatcaccaggatctgaccggcggctctgatagtatttagccggtgggcgattaccagaagagtcttcccttttaccagctctgaaatcgcctcctggatgaagcgttcattatcggcatccacgcttgcagtcgcctcatcgagaatcaccacaggagcatcctttaagatgcagcgcgcaatggaaatccgctgtttttcccctccggaaagactcgtgccgccctccccgatcacggtgtcaaagccctccggaagcgccatgataaaatcatagcatctggccttcctcgccgcctcatacacctcttctttcgacgcatccgtctttcccatgctgatattctggtaaattgtatcctgaaagagatatactctctggaacaccacgctgatatgatccatcagctccgccagcggcacgtcgcggatatcttctcctctcatccggatgcatccggatttcacgtcccagaaacgggccagcaggttggctgccgtcgattttccgccgccgctgggtccaaccagggctgtcattgtattcggctgtatctgaaaagtgacgtcctttaaaacctccttctcgtgataggcaaaggtaacgtgatcgaacgctatctccgccttgtgattccgctccggaatatgctttttcccctcatccggcagttctttctccgcgcagacgctttcaatccggtcgagacagctgttcatgaccgtgagccgcgttgcctcgccgtacagcgccttcagcgggccgaataaatcaaacacaaatagaagcagtcccataaggtacggaatggtcagggaaccggtctgctgcagatagatggacacaccgaacaacagcgccattccgcaggcataaatcaggttgagccccctttgccacggcgtcatcgcttcctcaaatcccagtgatttgtctctcgaccacttgaaattattggaaagctctgcggatttctctcccagcagattgtagcttttgatgatggctatcccctccgtaaaggagagcacggcgtccgtaagcttctcgctctgctcctgtctgccggcggcttccttcatggagatccggttcatttttccggctgtgaccatcgctgtcacggtcacgagcaggccgatgattcccagccgcacatcgaggtagaaaagaaataccgccatgagagctgcagaaaacgcgtagctcatcatattggcaatggaactcatggcgatctcttccacaaagatcatgtccgtagtcagaaccgagctgatctttccgatattccccgccgtaaagtaccccatgggaagcttccgcaaatgagcgcccagcgccatccgctgctccgcaaacatcatatatccggccccactctgcagccggtcactcataagctgaaaaaatgcttccagaagcacggacacacacagcacagcagcagcggtcacacaatctgcggccgtaattgcgccggtataaaaccgggacagcatgagaaatgccacgcagagaggcattttcgacagaatcgccttcagaacggaaaacaggaaggcggtctcaattctgcccctgtattttcctgacagctttaatattctctgaaataatggaaccattaccgttcctcctttccgcccgatacacgccactctgcgctctccatggaagcgttccagagtttccggtactcttcgctggctttcaaaagctcgtcatgggttcccctggctgcaattctgccttccgccatcacgcagatctgatcggcatttttcacagaggataaacggtgggcgatgaccaaaagcgtctttccccttaccacctcggagatggcggcctccatcttctcctcattttccggatccgtaaatgcggtcgcctcatcgaggactacgacgggtgcattctttaaaatggctctcgccagcgctattctctgcctctggcctcccgacagctgttttcctccgtctccggccatcgtgtgaattccatcgggaagtttttcgataaattccatgcactgggcctttgccgcagcctcaagcacctcttcgtcggtggctgtaagacggccgatcctgatattttcaagcaaagaggtgttgaataaatactgttcctgggccacgtaagagattctggcgtttaaggcttccaggctcatttcgcagatatcctggccgcctatggtgatctttccttcccccacatcgtaatagtgaaccagcagcttcgccagcgtgctcttgcccgaaccggattctcccacaagggctgtcttctgaccttccctcaccgtcaggctgacgtcgcggatcacggatttctcctcgtagccgaaggtcacatggccgaacaccacggtattgtccgcgccgtgccatccatcggcggtctgtcttaggggctccgcccccagcatttgctccagtgcattcagcttataattgatctgcggcagcgagggaagaaagctcaaggccctgagaagcggaattcccaggcttaaggacaggcacatcaccagaataaaatccggcagagaggaatatcccttcagcacaaaccaggaccccagaggcagcgtcacaatcagcgtgcacggcagaatactgttataggccgccatccacggccagcaggccttataccagtcgagggtcagattccggtaagccagcacatctctctggaaccgttcataggattcgccatcccggttgaacaccttcaccacctccatgccgtttatgtactcgataatggtgttgttcatgaccttgccggcctcatagtaactcaccatcccgttctgaccaatgcggtacatgaccatcatggccaggaaacccacaggcagggatgcgagggacataagcgccagcttccagtccacaaagaacagagctgtgtaaaccacgaccggaatcaccgtgttggcaaagccctccggcagagcgtgggccagaagcatctccatgctctccacgtcatctacgaacaggcgcttgatactccccgtccctttctcctgaatcacccccaacggcagcttctccatacggttctgaagagaaatgcggattctcatcaggatgttgtaggcagcttcatgggacagggacagccccttcacatacaggcaggcatgcagcaccaggcataccagcacgccggctatccggaccgccgcataggacaagtccataggttctccctcaatcagcggcgcgatgatctggcaggcaaagataaacgggaggacactcatgaacactcccagcaggatgaccgccgaagccagaaaggtcgtctttttgtagggccccgcgtactctaaaatcttttgaaacatatccgataccactcctttcaacagtaactcctgtcatgccggactctccggtatgaaaaaaacacgtcgagttagctttatctaacttgacgtgttatattttacggcgataaccgaagcatttctaccaaaaaacggtatatttctaacagtttttcattttccggcatactccttggggagcacgccgtatttctttttaaaggaggcggaaaaatggctcatgttggagtatccggacagcgcggccgcctggctcacattcttctgttcggtcagcagaagcgccgcgtgctccagcctccgctcgatcagataggagtgtatggtttttccggttatttccgaaaacaaccgggccagcctggagacgcttacgcctaccgcccttgccagccgttcgcagtccggcgcatcggtaaggtgccggtccagaatccgctttgcctccctcaccgcttcctgatcggttcgggtaatcccacacagtctcttttgggccttccggcatgtgagaagttcctcaaaggaggcggcgagcagttccagcagctttccttccagatagaggcggccaatcccgtcctcataccgcccggactgttccagttcagccagtatccggcagattccgggcgtgatctcaatgctctccaccgcagagctgaaccgctccgccgatatctcttccctgccttcaaaatacgcgttctgaagcctgcggtaaacctgtaccggaatctgcacgcttttaaacacgaaatcgcaatttcccggatagtatccccatgtggtcctgtctccgttccgatagatataggcatttcctttttccatggaaacaggtctggggatcccctcgatctcccagaccatgccctgattcatgcagaatacaaactgcacctcatctctgttgttctctccccgcctgtaaacatggacatcccgctggtaattcatgcgccagtccagaaggtcgattccctgtctcgtatttttctggcaaatggaaaaccgtccgatttcctccggcgcatttctcaaaacctcgtagacctgctccgatggcatctgttcaaaaagatcgttgaaatatcggcttgcatcctgcaccttgtgttcctcctttagcgggccttcctttgccggcttttcctctctcctatgccagcgcctttcccagctcctcgcaggcactttccgcctccgcgtccggagcgtcattgcagatcacgcagtcgcaggccagtacagcgccatcctcccggcaggtctcctcccaggttctcatccactcgccgtctccccatccgtaggagccgaagagcgcaatcttcttccctctcagcttcgcctcgcagctcaggaacatcggctcaaattcgtcctcctccagctgctcacttcccatagacgggcagccgaatgcaactgaatcaaattcatccattttgtccgccccgaattccgcagccgtaaacagcgagacctccgctcctgccgcctgcgcgccttccaccacttttgccgccatagcctccgtattgcctgttccgctccaatacactactgctgttttgctcatgttttaatcctctcttcctttctttttttaccaaccacagtatttctgctccagggccggaccgaacaccggcacaaggacagaaatgcctttatctcgtatggatttcgcaggttagttttaactaacctcaaatagtatagcattgggattccgtaaatacaagtaccgctatttaacaatgtttctcactatctgaaggaagagaccgggaggcagggtccgacagagggtcactgcggcggccgtcaggcttaagaatctcgattgccatgtacttttctgtaatattatggtattattttatatattttcactgttttttctcttaccaaaacacggtaataaaaagcaaaaatacaatcaggaaggttccatcatatgttaaatactatcgaatccatcaacaatgccgtgaacaattttatctggggcgtcccagccatggtctgcatcatcggcgtgggcctctatctgagtatccgcaccaattttctgcagatccgcaagttctcctattcgatccgggttaccctgggccggatgttccgcaagcgcgacgcgtccgacggtaccatgacgccatttcaggcggtctgcaccgctctggccgccacggtcggcaccggcaatatcgccggagtggccggagccatcgccatcggtggccctggctccgtattctggatgtgggtttctgcgattctgggtatgtgtacaaagttttccgaggtaactctggccgtgcatttccgtgaagtaaatgagaagggcgacttagtaggcggccccatgtactacataaagaacggtctcgggaaaaactggcgctggctggccactctgttttcggccttcggcgtcctcaccgtgttcggaacgggcaatgccactcaggtaaacaccatcacaacagcaatcaactctgcgctgctcaattaccatttgatcgaggaaggttctgcgcacaccaccagtcttatcatcggaatcattctggcggctctggtagccctggtccttctcggcggaatcaaaagaatcggaagcgtgacggagaaactggttccctttatggcgctgttctatatcgtgctcgccttcggcgtgattcttctcaatattaaccgggttcccgccgtattttcgtcgattgtttacggggcatttaacccggcggccgtcacaggcggcgtggtcggaaccttctttatgagcatgaagaaaggcgtctcccgtggcatcttctccaacgaagcgggccttggaacgggatccatcgcccacgcctgcgccgacacgaagaaaccggtcaagcagggctttttcgggattttcgaagtgtttgccgacaccatcgtcatctgtactctgaccgcatttgtcatcctctgcagcgacgttccggttccttacggggaagccgccggcgcggaactgaccattctcgggtttacttccacctatggcagctgggtctccatttttacagccgttgccatgtgctgtttcgcattttccaccatcatcggctggggattatacggtgcgagatgtatcgagttcctgttctcctcgcgcatcatcaaagcgttcatgatcgtctactctctggtcgcaatcctgggcgccaccatggatttagggatgctctggagtatcgccgaaacctttaacggcctgatggcaattcccaacctgatcgcagtgttcctgctgtccggcactgtagtcaggctggtcaaagaatactttgacggggaaggaaaagagtaatccgcgaattttaagaattattatttgcttcttgacatacctcgagtttctatgtatgataggtttacgatacatagaaactcgaggtattattttagggaaatatttccggaacggaggcaaatatggacaaaaaatatatggccgtaggctcttccatgctgatcctaaagctattggaacagcaggacatgtacggctatcagatcatcaaagagctggaaataagaagtgaacgcgtttttacgctgaaggaggggacgctttatcccctgctgcacgcgctcgaacaggatggggcggtgatctgcgaacagagaactgcggaaaatggccgtgagcgtaagtattacatcataaccgaaaacggccggaagcttttacatgataagctgaaggaatgggattcgtttcagacggcggtgaatcaggtgatcgggggtgttttgtttggataaacccttccagaagaatcacaatcagcatacggattatgaagaagcatttttagaggatgtggcggatcagatcgcctataagcctctgcgtccggcagtggtaagagaattaaaggaccatatcgatgacaggacggaggagtatctctcagaagggataagtcccgaagatgcggttaaaaaagcggtggatgccatgggggacggtgtcgcgatcggcaccgggatcaacgcggtccgtcacgtccagtccagccgccttctgatggttctgaccgtgattcttcttctcatcggtctcgctgcggaaacctgcacggccgtgatcccggaactgacgttccgcgggctttctatctatctgactggcgctgtccttctggtggtcatggcgctgaaaggataccctctgctgatccggtaccagaagcagctgctcattctggcggcagccatatttaccgcggaagccatattcctttccatgatcgaatttgattggatagcggatgtaatctgggacacggcatacatcattccatggcatatgattgattactatgcgcttctgctgaccggaccggttgttgccatccttctctaccggatgcggaagcagacaccgaaagccatggcagccgcttttcttctcactgccggggcagcccttatccattactttacatacaacagctttacgctggccgagaccgtgactttcctcttctccatgatcggaaccgtgttgtatatgatctgccgggagatgttcaccggaaataaaagaaggctcctgatccaggccgccgccgggggcgtggtactccttcttttttatgggatgcttcccggccagtcccagtattttcaggcatttgtaaatccggaggcgaacgcatacgacaccttaagcgactcctataacggggttctgattcaggagctgctctccaaatcaccgctggccggcaggatttcgcttacgcaggaggagctgatggagtatggaaccggcgaatggtatttcagctacggagatgccagagaggctgccgcggaagggaaaaagccgttttctgaacatcaccgctccatcttccgcttcgatccgtcagatgtcactttatggaacattctgccccagcattacgcgaacaactatctcctggccgtattcatactacagttcggctggctggccggaattctgtttcttgcagttatggccgccttctacgcagtcctcttctcctgcatccgaaggatacacggcgcgctcgccggagcggtgtcctttcactgcggcctgtgcctgctgtttcagagcgtgctctatatacttgggaattttggtttccagtatggcagctttactaatcttcccatggtttcggagggcagtatcagcatcctcgtaaatatgcttctgctgggatttatcttctcggcctaccggtatgaccgggtcatcgatgcgccggcctgcgggcagcgaagcagtgcggtctgaattgcagagcggccttaactggccgcctgcaattccaggccatagataaacatattcaggcggtagtctgtatgggggctgaattccaccgtcttctctcccagccgctgcattccccgcttctcgtaaaactggtaagtacagctggaatccgtgaagaggtacagggtctttaccccttcctgttccagataatcaagggcctgggcaaaaagcatttttccgattccggttccccttgtactctcatccacggcaaagaaacagatttccgcgtcaaaagcatttcctgcatttttcagcagttcttcgtccgtttggtcgaaggtactgaaaaatttaccgattcctcttccggttttcgttgtaaacagcagcgcaatggaccagagctgagccagggtgcggcgaagggcgaatttcggaacggattttttactcccggccagaataactcccagcacctttccatccacagccgcgacacaggaaaatgtcgcccgcagcagacaggaacgcagatacagccttgccatatgctttgcatccttcggattgctgctcagcgcgtcgtatttccacgtcttgcgtatgatatcctctataaacggataatcctttcgtgtgatggggcgcagtgtaatatgttctgaattcatgattctattctccttttttcttgtatttgtactgtcttacctgtataataatccatacagtaactgtacggtaaagaggaaaaggggatttttttatggaaagagaaaaactatttacgatcggccaatttgcagcccttcataacatcaacaaaaagactctgatgtggtacgatgagatcggcttattcaagccggcggtcgtaaaagagaacggctaccgctattacacctactatcagagctctttgctggagacgattctggttttgcgggaactgaatatgggaattcctgagatcaaagagtttttagacaggcgtggggcagaagcctacgttcagcttctgcataaaaagattcaggacgtggaccgtgaaatagaaaagctgaacacgatccgtgatatgctgacggaccaatgcggtaccttcaccgatttactgaacaccgatctgacccggatcgacgttgtcgaatgtgaagaggagtatctgcacatcattgcctccgaccaggccctgtccatggaggatgagatcgaacagatggttgaatccatgaaacagcaccattttaagagtctccacgataccacttacggctccctgatctccgtctcccacctgctccattccgagtttgaccagtatgacggcctgtttatgaaggtttcccacacagcttctgtaaatgaaatccataaaaagccgagcggcagctatctgtgcgcctactgtacgggaagctgggacaggcttccgcagcgatattcggaaatcctggactatgcgaagcagcacggcctcacacttttcggatacgcctacgaaacaggggtaaacgagatgaccatcaattccattgacgaatacattacacgaatcgtgattccggtcaaaaactagacgatgaataaaggccccgcatcccgctgccggataaaattctgcagtacctccagcccccggcggagttgttcgtcactttccgccgagctggttgccactctgacggcatttgctttcagctgttttccaacatagaagcgctctgcgccgaatacgctgactcccctgccggagagctcggcctcacacagccttccggttaaatgctccgggagttccagccactgataatacgattccatgcaaagttcgcggtcaggaaaaaaggaggcataaatctgattgcgctccgcggccgccgctctctttttctgtatgattttccacgccaggccgcttcggattatctcggctgcaacctccatatttaaagaagaaatcttcaagttctggctgaacatcccctgttccatggcattgatatactgatccggcagatataaatatgcaattcttatccccggacagagcggcttggaaagcccgctgacatagatacagtgttccgtcgcctctaaggcgaggggcgaatacggtgtctcaagcagggcggcgtaattgtcgtcctcaattgcaatcagattttgttttcgtataatctcagcgatctccctcttcctcgaatctgaaaaggcgatattggtgggatttcctcccgccggcatcatatatacgccttttatcttttgaagcgtacagacattttccagttggtcgggacgcattccccacacgtcattttcaatgggcaccagctgtaaataaagctgattggccaggctgatgaaattgggatacgtgtaggtgtcgacggcaatgcggtctcccgcctcaaaaagtgaggaaagtatggtcgcaagtgcattctgagcgcctgccgcgatcatggtgttgtgctcattggcctccaggccaaaccgctgcagccaccgggaagcggccagaatctgccctctgtcccccaggggatgggagtactcaaacagcctctctgaaaatggttttttcagaatctccatggtcagatcccggatcgccgcgttggactcgtagaagggatggatgatggccagttcgattctgggtccggtatttttctctactgtagacgtggggacattggcataaggcgtcacatacgtcccttttccggtggcggcgtggatcaggccccgcatttcacagagcttgtacgcctttgtaatggtgctcagattcaaatccagaaagtctgccagctcccgctgcgggggcagcttcgtattggccgccagcttcccgctcttaatatcctgctccatcagatcggcaagactgtaatagaccgggtaagccagcttctgcttgtccggcttccaggacattggataattctcaaatgaattaattggcatgataatctcctctatggcgtgtctgtgtgtgctgccgcgttggaaaaggcggtgttacggtcccggggctacgattgccgggcaggtggtgttgtccgacagattcggttggtttgacggattcggctggtttgacgaattcggctggttcggcatattcggctggttcggcatattcggctggttcggcatggaagcgtcggaaatgggggatgccgctggtatttggtcatttctgctttcgcttccaggcggggaggatggattttctccattgctgctggtatttccggggccagccgtctgactgactccgtttccgtttccactttcagacgcagacgtctggttccctccgtcttcacggccatttccattatccggcgcggccgtctggttctcaccagtcgtattttctgctgctggcgtactgctttctgtctggctgctgtttggaattgttttcatcgatccctcttcggagactgatgaatccgcggaagaggacgaacctcccgataccgatgaagctcccgccttcgacgtatctcccgcccccggcgtagtcttaccagtttccgttccatccagatgataacacaataccggtatgtgtgcctcaatattttcataaatagtttttgctaccgcaggaggaaggtttatacagccatgggaaccgtttttcttatagatggtcccgccgaaactggaccgccagtatccatcatgcatcccgatatttccgttaaatggcatccagtatgtaacaggcgtattatagttcttgcccttcagcaccgcgttgcgctgcttataggtcagttcataggcgccagcaggggtactccagcccttcgcctcatttccggatacaaaatccgattcaatcagcagcttcccattcttataatagaacaaatgctgggcagtgagattcatttccacataagtgtccccgtaatccgggccgtcgtggctggccgctttctgggcgtagaccggctcccgctcctgactttcaccggatctgattatttccaacagagcctccgtttccgcctccttatcaatcagccagccgtaatgaccttttgtgatcgtcacagtggatccataggaagttttcagttccttcgcacagtatgcagtattgtattttttcgccagattcaccacatacgcttccactccgctccggtcaacgactgcgcttccttctccatccatcgacagccacggaagaatcgtacttccgtccagtacctcagaacggcttccgaaccgataggtcacggtcacatctgcacagtcctttaacgcctccttttgagccagcagttccgggtccgtctctgagactcccggttctttatagacagcccgttcgtccagcgagatacgtgtttccaggctggagaccgcttttcctatttcttctgacagacgttcccggacaggcgcctttcccggttcttccttaataatctgtaatccgcttccactcacaaaggccacatacgcgtcagccggctccacaaccgttttcgacttgagacattccagagcagcgaccgccaaatccatgcttcctttatcatattccaccatatagctggaggcatactcggcacctcttatggctcgcagcccccataacagggaattctgcttcctcaaaatgttctctaaggtcccgtcaaagacaggatgcagaccgatcgcttctccatttatccgctcctctgctccgtccctctcctccaggatcagttcataacgttcgattcccttcctgatctctgactgcacctcttctatggtcagccccgagacagtaataccgccaatcctcgtatttggtagaaatgtatttctgtatttcaggctgatcatgcagtagactattgctgccgccgctatcatacaaatggaaatacgtctggtaaaatagatccattttcttcttcttcgccgtcttctggccttcacgctgcgatccgtgatgtttttttccttacaccgcttcaacggccgctccccgccatgactccttctttcaaccatatttctttcttatactcctcatttcaatccgtctgtcactttacctctgcaatacaactttgaatctattggtattatatcatcaactttgcaccacaaaaacaggagaattgtgtggcagacaatttaagcagcaaaaccatggtaagagagcgattccccgataagcaaaaagaaactatagactttttatttgaaatgtagtagactgattcaggaagtgcagatagaattatctgcatttttttcatttaacagatccgctctcagaaagtgaacataaaaatatatgataaaaaaggacagcgcagatttttcagccgtgaaaaccaatacgcaattaatgggtgatgagaattttgcttatttttcgcccagcgagcagttgaaaacactgatctctaactataccatcacctttccaaacaaaggtgtcatttccgatgactatactatcgtgccgcatggaagtgcaactcttgtccttacatatgacggggccgatctgcgcatcctgattttcggaccgtcctccaaaccatattttgttggaaaaaatgcgaatgcatgcagcgtgatattcattatcgaatttcagccggcagggctgtttgtattcaccggaacaaagcagaatcagctgatggatacgatcatttcctttgaacagatcgcgccccgcctggattcttccataaaagaaatcttctgcaacgcgggaaccgcggaagaactgctgaccagaatcgagagtctgctgctttgcagccaatgcagccaatacccggctgaattccgtctggccgtgcagctgatcattcagagtaacggtaacataagtctcaaagaaataacagaaaaaacattttacagtgaacgtcatttaaacaggctttccaatcactatttaggatttaacctgaaacatttttcccgaatcgtgcgtatcaacaaagccatttatctgctgcaccatacgagctacagcctcgattatatatctgccgaatccgggttttatgatatttctcactttatcagggattttagggccgtatgcggcgttactcctcaggaataccgaaacaacttgtccgatttttacagtgcgatcgcaaagttttaggctataattgagaaaaaaagaggaggtatccatatgaaatacggaggcacattgcttatagttgatgatatggaaaaatcaaaatatttttacgaaacaatcctggagcaaaaagtcctcatggatttaggagaacacgtctcattggacaatggcctcagcctgcaggcaaactacgaagcaatgatcggtaaatcactgaacagaaagacagcagcaaataactttcagctctattttgaaacagaccggatcgacgactgggagagaaagctggaggccatcgaaggagtggaatttatccatcacccgacggaatatccctggggccagcggagtatgcggttttatgattttgataaatatatcattgaggcagcagaaagcatggagtgcgtcatcaggcgttttctcagccagggactagcggttgaggaagtgtccaaacggactatgtatccggttgagtttgttgaaatgctggtgtaatgaatcttcatcaccgtttccaggcagtccacgaagcctctgcttccagtaatagcctgtttgggacaaggcggtattcctttgtcccaaacaggctcctttcatatgtatcattcagccgttaccggccatatctcattatcaaatacttcttttctctttccggccacgatccaaagtgcctttgcaatctttctcggtaccgctatttccccctccttagccttcgtaataatatctgtaattcttatgcaggttatatcatccattcccgtattcaattgcttatcaatgataggctgtaggtctttttcatctgttgcaaagataggtatgctcgctgcttttgcatatgcgagcgaacacatctctcctttattcttgtttggtctcgttgcatcaatcataactctctcaagattacgataagctgcatcatagattgctcgtaccttgctgtccaaaccactttcgttaacaagaaccactttattttccgtaatcaaatcctttaactggctgactgcactggcaggcatcaacacctctccaaaggcgtgtgtatgcatataaatctcttttgcaatcaaaggaagcacatcatgcaaatatctatacttattacttcctcccaacttgatacataaatctgcatcaataattatttttctaccatactcattcctccataatacgatctaattcatcatcagaagggaattcgcaggcagttttcttttcaatgcctaaatcctctggctttaaggtactgattctcagcaaatattccagtttctcatatgtaatgtacccggcttcataagcggcgacggctaactcaaccaggttatccatgataatccgaccatcagatttctgagatggtatggaatatctcttcttatatttttcaacagaatcctctgactctgcgagaaatctatttagatccgcatcctcaattactccaatttctcccagccgcttcaccattgtcctgtatggaaccgtaaacagttctgctaattgtaatatgctttttattgtaagcttcttaattttatataactcgatttcctgtttcagcaataattcatccacaagaaattctgctgcaaatctatttgcttttttctcacttgtctttttatcgtgttcattcaacaaatcagaaggaagcatatccggattttgttcataccaaatatggtataattcgtgtgccgctgcaaacacctggcagtccaccggaatagaagaattaagggcaacaaatggcttctccaatgaggcatcatttctagaaccgctgattctggtaaatccccaaggtgcattttttcccagaggatagtaaattactctggcatacaaaccaaggattgaaaaaatctgtgtccctataatatcatttccttttctgcacagtcctaacttttctattgcatgattctttatttcatttacttctaattcatttaagtcattagtcatccagtaaatcctccagcatatgaatctcatcaatcgcagatctgatgaagttaatacgttcccgtgtaacctcatcgtaaacatctcccataaagctcaggctgtcaacagtagctggttcagtcccaactgtaagtaattcatctgcagatgtgttcaggatatccgcaattcttgcaagctcattcacattgatcgccttgcttcctttaatgattttgttcataacctgctttgatataccaagagcatccgccaaactctgttgtgtcatttccttttcaactaatttattttgtatgttagctcctaccagagcgaaatccattgcgtacatggtcttatcctcctttgctttgatagttattataccattaaaaagctttatggtcaacgttttgtttactattcatctatttcttgtttaattttgtttactttcaagcatattctaaacaatttgatttcaaaacagaaaaaaggactctatgactaatgtcatagagtcctaatttcttatcattatatcagtaagcgccacttctgttcaaacacatctacatttttcaatgttaacaaaattgggggtaacaacttttgttattgaattcctactatcctgaaaaacggttcttttgttgtattttaatacaacttcgcccccgccggaatcctatcatccaccatcagcagattcagtccctcatgtccgtcttcctcatgcacggctgaaatcagcataccgcaggagtcaattcccatcatctttcttggcggcagattcacgatggcgatggctgtcttaccaatcagatcctccggctcgtagtactcatgaattccgcttaaaatcgtgcggtctgtgccgcttccatcgtccagagtaaactggagaagcttcttgctcttcggcactgccacgcagtctttgatcttcactgcacggtaatcagactttgagaaagtctcaaaatccaccatctcttcaaacagcggctcaatcttcacattggaaaaatcaatctccaccgcggctttcacgttctcagcagccggagcagaagcagcggccggagcggccttctctgccttcctgctattatcagaactgcccagcgtcttcatggtcgggagcaaaattcggctcccttcatcctgctccatgccgctctgtaaggcttcaaagcctgcacaattctcggttcgtgaaacttttttcattcgtctcgtgtcctcttgtgccgtccttctcgcttcaaaagttgtagaaaagttgtagaaagttgtagtgcgcctgttatggcatatcgctggcacaggaatggcagaaaactgctgtgtttctcaggatgctgttctaccatgaactctatataaagaacggcttgatcttttaaccgcagacgcatacattattatataataaccttcaagtccatccaagtcaacgattttatcgaaacattttattacttttattaccccgcctttaatacataatacataaataaagaggagactgtcatgccagaataccaacttcaaatcaaacaagtggtagattacccacgatgccggatttatcgtgagttcatccacaaactgatcaacgaccggagcatccgcataaacggaggctccggtctttttcattttactgtactttgcagctatgcaaacttccgcacctcataccgccgtattgacgggatcagttatacagtctcgcccggcgaatgggtgtgcaccgtcaaggaactgtcttgctggttccgcacccgctttcatcggcaggcgctgtccatgctggatacccttcagaagcagcacttgatttcctatacactgctgggccgtggcaatgtagtcaaatataaaatcctccactgggcccgccacaattccgcactggagtacaatgccccatgccaaaaggataccggttttttcttccttccagtctctgttgccctggaactggtcagctctgcccgttgctctgaaatggacatcgttctggatctgtgggtatccgctgtctacaacgatacgcaggtgcaggggtcagaggtcggtccggtagcctattttcgcaatggtacaggaaacccgttggtcagctataccgaactctcctgtcgctgggggctgtcacgcgctaccgtatgccggatactgaaaaagctggacggtcttgggtatatctctatcatgtcgtttcccggccggcatggaagcgtgatctacctgcagaactacctgtccaccatgtttgagatttccgatgttttaatcgacaaggaggaagttgccatgaccttaaacattcatctggagcttccggaaactgctgaaaccgaagagagccattccatctctgagcatgaggtcattgtttcggatgcactttccagcgtttcaaaatcgcacattgaaacgatactccgcaagatggctgacatcctatctacgcaagggatttcctgcttttcttgcccgctctcccgctataagttatatcccttatcggacgactgctgggaagagttgattccgcgtgcgcgagggaaatccacagcccactttggtctgaccatcctctgcggcacaaacacttcaatcgccacttttgaacttacactcactccctctgaggagcacgaaaataggaggaacctgaaatgagaaaatttgttgaacctgatgttgctgataatcccctgtaccatgatacctggaaactgctgaaaaaataccgagatgttgtgtggagcctggagctttctgtccagcatgtccgcaccaagtttgagatcgagtattgtacctccattgaggattttctggattcagtctatctggctggcgccgatctggccggaagcgacatcgagcatcatgccaaatgcattgaacgcagccacaaaatgctcaagctgctggattccgcaatcgaattgctgcgtaccaagcacaaaaacggtgaggcatattactggctgctgtactactccttcctctcgccgcagcagctcaaaaatgttgaggaaatcatcgagaccctacgaccgcatattcgtgacatcagtttcagaacctactaccgcaaacgccgagaagctattgaagccctcagttccgtcctttggggctatacctccaaggacagtttagacatgctggaacagttctttccagagacaaaatcaccttccggacaatcgggcaaataattggcacaattcgggaacaaaattggcatggttctgctctttcagtgtaaataccgatgtgttaaactgaatatgctcaaacttgcacccaaaaccgaacaggacagtaacggcacctttcatcagggtgcttttttgctgcccagatggccgcccggccatttgaaagcccacatttgttttgacaggtgtgggcttttctgttccctattgagcatcaaaaaaatcattcagaattggaggatcgcaaattgaagaaaacgaaaacccctcaaactccgcagcttcaggagccggatacccagtccaagcgcaggctttcgctgcccaaagtggcttacagcgccttcctgtgtgtgatgatgtccatgatgttctgccagccggcttatgcggcaacagatgtatggaccaaggccaaagagatcatgcaggatgtatacacccaaatccttgccatctccactatcgccgccatcgtcactgcttcggtagccttgctgctcatgaacttctcccgttccggacggacggtggatgaaagccgcgcctggctcaaacgaatctgtatcacctgggctatcctcaatggcttgggctttatcatggcgtatgtgacgccgctctttagtggcggacaatggacaggctgattgaccgtctgactgctcgccggaaaggaggcttgcatttatgggcattttagacggcatagtggaatggatcgcagaacaggtaatggccggtcttgatctggtgaccacatcggttttgggtgcgctgggctgtgatatggctgtatttctgcgttattttcccgcagcagagactatgtactctgttttcgtggctctggcaatcgggatcatcctgctcaactgggtctggcagttattcaaaaacttcggtcttggcgcaggtgtggaagcagaagatccggtaaagctgagtatccgttccgttatttttatcctgctgacgctcttttcagatgagatcgtcaatattgttcttaccatcggcggcaccccctaccactggatcatggagtccgaccttcctgcattaagctttgcagacttcaattccgtgatgctggtcatcatcggtgtgtgtgccaatggggctgtggcgctgattaccttgattttggttctcatcctggcctggaactacctaaaacttctgttcgaggcagccgaacggtatgtgctgctcggtgtactggtctacacggctcctgtggctttttctatgggcgccagccagaccacagcaaacatctggaaatcctggtgccggatgcttggcggtcaaattttcctattggtcatgaacgcctggtgcctgcgcctgttcacaagcatggtggggtccttccttgcgaacccgctttcgttgtaaggaggtcttatccttgaagaaactcaaaaaatttttatttgcggcctttacagtcgcaattctctcctgcctgctctgccagccggcttttgccgctatctccgaaagcgatgtgcaggctcaggtagacgctttaggaaaagaagccgtttccggcaatgtgtttatctggtttctctgtgctatcggctttctcaaagtcggccagaaaatcgattccttcctctccagtctgggcgtcaatgtaggacataccggcggcagcatgctggctgaagctatgatcgccgccagaggcatcggcggcatcaggaacttttccagtcaccactttggcggcgggagaaacagcagttccaccaatgtcaacgcaaacggtggtaaaggcagcggtggctttggagcagggtttgccagcggcggtcttgccggcgtggtaagccgaaaagtcacaaacagcgccatcaaaacagccaccacagctccaaactccaagccttccgctcttggcagtcttttaggtgatgccgcagccggagggatcggaggccatatgtacgcttcttccgtcagcaagggtggaaactttgccaacaatgtaattggtagcgttgccactggcagtatcagccagatgggttccatttccggtgaaaaagccgccgaagccctgcactcttacatgggatatgcggcactggaatctggagctgaaaatgttcctaccttccaaaatgtcgaaatcggcggcggccgcatcaccggcacagaagtgactgcggaacatcccgaaggcatctcctttggtatgtaccacgcagaccaatatgttgccccggaaggccagtacaccaccgttcatgccgtggatggcacagcatggtataagcagtacgctgtggatgctgttgacaaatcgccctatatggctcctgacggttctatcgccttcaacgagtccattgtcaaaaagctgcctccagccccgaggagaaaggacaagatataaatgccagaagatcaaaaacgcagtttttccgaagctgtggagactggtgcctccgcagcgcataccatccgcggcgcaatcaaaaccggaaaagctatttcctccgctgccaaaggcgctgccgcaggcggtccttacggtgcagctgcaggcgcagtgtgggcaggtcggaagcatatcggaaaaatcattgtggcagtcattgccctgcttatgctgccggtattatttgttctcatgctccccggtcttattttcggcggactgaccaatgccttttcgccatctgaccccgaaattccgattttgaatagcgaaacagcgattattgagaacgccaacgagatcacctttaccctcaacggcatcttgggcgaggcactggatgatgtacttgcccggatcgaagctgactttgcggcatcgggagccgaccatatggaggtcaaaaatgcctattccggcggtcccatttataacgccaacctgtttatctctcagtattgtgcggccaaagacaaggattttgaaagcatttctctgaatgaccttgccgccaccctgcgggaaaacaagcagcatctatattcctacaccagcaagcaagagattcgtgagagcaccgtgactgatccggagactggggaagaaacaacggtgtccgaaacatggatggtctatactgtccgttacaacggtgagtcctatttttctgatgttgtattccagcttaccgatgaccaaaaggagcttgcatctgattacgcttccaacctaagcctgttcttgggcgatggtctgctgcaaaatctggaagcgtggaccggaaacagcatcaccgctctgggcgatgttactttcaccgacgggatcacacctgttgtttactacaatcaactggatgaacgctatgccggtaaagcatatggtacggacaatattggcggttatggttgcggccctaccgctatggcaatcgtggtgtcctctctgacggacgatatggttgaccctgtggagatggccgagtggtcttacaacaacggctactggtgtaaaagcagtggttcttaccatgcgctgatacctgccgccgccggggaatgggggcttccggtttccggctgtaccactgcggaaccacagcgcatcacagacgcactggctaatggtaaactggtagtagcaatcatgtctgaaggccactttacctcttccggtcacttcattgtcctgcgtggcgtaaaagacggcaaaatcatggtggctgaccctgccagttacacacggagcgaacagctctgggatctgtccattatcttaaatgaggccagccggcgcgctggagctggcggtccgttctggattatcggctgatgtgcccgcccggcttcggaaacgaggttaatcatgaatcataaaatcgaccgagatacctacataataccaccgaatttcatcgagtcaggcaccttcttcggtggtatgttcaaagcccgcaatgtgattgaagccggcatcctggcatttgccattggtgtgccggttttttcattgcttcctcttggcctgactgcccgtatcatcgctttgtgcctgaccgcactgccagcagcattggtggcgcttattggaatttccggtgagagcctttcctcttttctgctgattttcataaagtacctgcgaaaccgccgcattgtaggcggtaacagcgcagaagatgcggttcctgcggcagagcatggcggcaagcatattaaaaaaaaggcacacaagcccgataaggctcccaagcggtcacggcgctccggcagagaggatttcccagcggagtttgatgaagttcgcggctacgaaattcgccaaaaactccgtcctgtgaaaaagcagaagcctgccaaggagaagaaagccgccaagcaaaaaaagaaggtctccaaagagcgcaaagtaaaacgccctatccgcactcaggagcctaagcccgcctgccttaacccagtagcagattatctgccgatttctaaaattgaaaacggcatcatctacacgaaagaccaccgctatgtcaagatcgtcgaggtagtacccatcaattttatgctgcgcagcgcccaggaacagcggaacatcatctattcctttgtgtcctacttgaaaatcagccccatcaagctgcaaatcaaggtactgacacgccgggcagagatcaaccgccatctggataccgttcggaaggagatggaacaggagaccaatgaacagtgtctgctcatgcaggaagactacctccagttcgttcagcagatcggttcccgtgaggcaattacccgacgtttcttcctgatttttgaatatgagccgtggagcaacaccaagcgctctgatgaagaaggcgaggcaatcaatgccctgcaaagtgcagtccatactgctaccaactacctccgtcagtgcggtaacgaggtcatcgttccggaaaactgggatgagtttaccgtagatgtcctctataacctgctctgcagaaatgaaagtgctgtaaagccgctctccgtccgggcacaggaggttgtggctgagtaccttgccaaagggcgcgacagtgagatcgaccatatccctgccaccgaattctgtgcgccaaaaagcattgacttcacgcatggtcaccatatctgcattgacggtctgtattatgcctatttgctggtgccctctgatggctacaaaacgcaggttccagccggctggctcagtcttatcgtcaatgccggtgacgggatcgatatggatatgttcctctcccgtcagcccaaagaaaccatcatccagaaagtcggacagcagctgcgtatcaaccgttccaaaatcaaggacgccagcgacaccaacaccgactttgatgacattgatggcgctatccgaagcgggtactttctcaaagagggccttgccaacaacgaggacttctactacttgaatctgctgattaccattactgcctccaacgaggaagacttggaatggaaggtcagcgaaatgaaaaagctcctgctctcacaggacatgaacgcctgcacctgccattttcgggaggaacaggcgtttttatctgccctgccattggtggcaatggaaaagaaactgtatgagcggggtaagcgcaacctgctgacaggcggtgcggcaagctgttatccctttacatcctatgagatgtgtgatgataacggtatcctgctgggtgtcaacaagtacaacagttcccttattatcgtggacatcttcaattctgcggtctataagaacgccaatatgtcgatccttggcacgagcggagccggcaaaacctttaccatgcagttgatggcgctgcgaatgaggcggaaaaatatccccattttcattgttgcgcccctaaaaggccatgaatttcatcgcgcctgctccaacgtgggcggctcctttatccagatttcaccagccagtccccactgcatcaatgtcatggaaatccggcgggtagaccgctcggtgaatgaacttctggacggtccaagcatccagttatctgaacttgcagcaaagatccagcagctccacatatttttcagtctgctgatccccgatatgtctcacgaggaacgacagcttttggacgaagcccttgttcgtacctataacacaaaaggcatcactcatgataatgcctctttggaagaccctacaaagcccggccagtaccgtgagatgccggtgcttggtgacctgtacgaaattttgaaaacctccaaggaaacgatgcgcatggcccacatcctaaatcgtctggtaaacggaagcgccagcaccttcaataagcagaccaatgttcggctcgacaacaagtacactgttttggatatttcctccctcaccggagacctgctcaccgtaggtatgtttgtggcgctggactttgtttgggacagagccaaagccgaccgtacagaagaaaaagccatcttcatcgatgagtgttggcagcttctatccggcgccggtgctgctggtgtaagattggccggcgattttcttttggaaattgccaaaaccatacgcggttacggcggcgcctcgatttttgcaagccaggatcttgccgatttctttgaccttgacggcggcagatttggtaagggcatcatcaacaactccaagaccaagatcattctgaatctggaggacgacgaagcccagcgggtacaggaagccctgcacctgtccgatgctgaaacaatggagatcacccactttgaaagaggtcacggtctgatttctaccaataacaacaatattatggtggagttcaaagccagccctctggaaaaggatctgatcactaccgaccgccgcgagctgcgtgaaatcgtagagcgaaaacgccgtgaacaatccacatctgccgaacagcagatataacaatttgaaaagcgaggtgattcccatgtgcaactttcctgccagacgccgctatgcgtctgctttgcgtctgtattacgcctaaaagccagttttgccagccagatcatctttttggcttacactgactggctttccttcctatttaatgcgtcttgaatacgcctatattacgccattggaggtgatacccatgaagaccagggctgaaatctatggaaatgaagctgcggctctgctgcggatcgtcacgatgtatcccggtctcaatatgcagcagcttctctgctttcaccctggcaaagaagaaatcatcaagaccctgctctcccatctgcaaaagcagggccgtatttttcaaactgatacaggcggttactttccgtctggttgggcagcaaaatcggacagctccctgatacgggctgcctgggtactcttggattttatcgggcaggtggaataccatgctcccggtgattttccggtcaagcttatcttctttgcaaacggtgaactatatgaaatcgtctacgcagcttccggccaggaggccctgatcaaccatgcgcttcgggatgaccgcagcggtggacgccgcatcattttggtcgataatccggaagacattcgccgcattgactgccctggcatttccggtttctgcaccgtggatgcggcgggccaggtgcattactttaagaaaacaggaggaacttgattggaacgaaaaatcatctcacaccgaatcggaagcattcttgatgatatatcccgtttgagcaatgctctttacgcgatggataccacggatattcagcgctatccggacaactatgaagtcttatccactgatgccgccctgcgggcagagaaaattgcctgcaggctgcggcatttgatatattccagcactaccatccgcaaaggcgattacctgacatccgccggtattgtacacggaattgaggttgtctatgaggacggtgtactggaggtcaccctgcccggtctgctcccaaaacgcaagcagaggcaaaacgctgagtttctgctcgacccgttctacttctcattggagcaatacgccaaagagcatcccatgcctcgcttcagcgattgtgtggtgtgctttacgcaagtttatgaccagtgccttcccacccggcgtatccgtgactacgacaatctggaagaaaagcagcttctggatgtcctctccaccttcgtcatggctgacgataccggcctgctctgcgatgcctacaacaccgctgcgctgggcgaaaaggactgtaccagaatcagtgtcatggaaaaaaagcggtttcccacctggcttgctgagcatgaaaacaccctaaaatccatctcggatttttgagcattttcagccattgcttgtccgacctgccgcaacaccgtatttcgccccggatttcggggcttttttctgtcgttacaccacggatttttaccgaagttccttgcagtctcggtaaaagccacacaccacaaggaggtgatcacttgggaaattcccacagccagacacgatggcgtacaggcttctctctctgactgccatctccggcgagttccccacagaccagcttaacagacttcccggcagtccgtattatctggagtctgttgtcactgcactgaaaaaagacgggctgctgcgtacctattaccgggataaactgcgcggctaccgtctggggccgcgagccaaagccactctactggatagccgaccggacaggtttgccagctacctgacgggagataccgacaccaaccgtttgaaatgcgaaattgaccgaagactccggctacaccgcctggcagaaacctatatgaccatggataatgcgggtgtatgtgtgtatcgggatgaaaaaccggcaatttttgcgccggagggttacgctggcggcaggattgtctatcctgcttttttcagttccagagaagtgaaagaaatggggatcgacaccacgaagatccgcagttcccgctccactggaatactccttgcgccctccggcatcttcgtgacctacaacagcagcagcgccctgatgaagtggcgctacaaatcggaaatgcgggtcaaggcattgatttggagcgtaatctgccaacagcgcctgtccccacagtttcgccatgaggatgttcatggactgattctgggcaacagcatggatctggcttaccagattttgaccagcactggaggacgcaaacatgatttcttcatgctggatggcagctatgagcattttctttatcttaccaacgaccatcagggggaggtgatacttgcactgctgtgcgaccctgggaaaactgcggagctggatcgcattctgctccaaggtcttactgcgaagcagcccggactggctattgagcatgacggcatttcaccggatggctcaccagtcctatttggctatttctgcgatctgccccgtatcgcacgctttaacacctctctcgaactatccgagcgcccgggcacactgatctgctttgacttccaggcagaggtacttcgcagctactgcggttcccgggtgcgcttccagaccattgacttcacaaaattcgaggggaggttgttcccataaacaagaaaaaactgatcgtgagcctgattgcagcgccctttgccattcttgcaatcctatacgcaggcggctttctggcacagcttttgggtaactatgcaacctggaaacatggcggcggtattcccggcgatggtacttcaccgctggccgcttcgcccgacttccttctctgcctttcctctgtgctccgaccgccttatggcgtgtatggcattttgatctgcattggcttgttagcagtgctgctcatcatggtcatgcgcatgggatatggtgatgccggcgagtatgatgaagaccgtaatttctcctactccgccaaaggcacttatggcacctccggctggatgtcccgcaaagagatgtccggcgtactggatctggtgcccgacctgcgtaagcacaagggcgttgtactgggtatgctggatggaaaagcagtctgcataccggaagataccagaatcaacagcaatctggcagtctacggcgccagtggttccatgaaaacccgttcgttttgtatgaaccgtatccttcaggccactgtccgaggcgaaaatggcgccggagaatcgctgatcatctgcgatccaaaatcggaattgtacgagaagtcaagcgaatttctccgcagccggggctattgtgtcaaggtattcaacctcgtttcgcctgaaaactcagattcctggtgctgccttgccgaagttgaggggcaggaactcatggcccagctttttgtagatgtcatcatcaaaaacaccacgaacaacggcaagagcgaccacttctgggatgcctgcgagatgaatctgctcaaggctttggtactgtatgtggatcaaggctatgcggaagaaaaccgcaacattggcgaagtctaccggctgctgactctcaatggggaatcccagcttgacacattgttcgaggcgcttccttccacgcaccctgccaaagcaccctacagcctgttcaagcaggccagcgacacagtgcgaagcggcgtgattatcggtctgggcagccgcctgcaggtattccagtctgagctgatcaaaaaaattaccgctaagaatgagatcgatctggagcttccgggtcagcagccctgtgcctacttcctcgttaccagcgaccaggacagcacctttgattttctggcctcgctgtttctatctttctgcttcatcaaactggtgcgatatgcagaccacaactgcgagggcggcaaactgcctgtgcctgtccatatccttggggaagaactgacagcgtgcggcacgatcccagacctctcccgccggctcagcgtaatacgctcccggaatatctccatgtcctgtgtgttccaaaatctcgcaggattgcagaacagatacccgcagaatttgtggcaggagatcattggaaactgtgacgcgcagttgtttttaggctgtacagaccagcttactgccgaatttatttctgccaggacagggcttgcctccgtagcagtatccagtaagtccaaacagctgggcacctggcgtatctccaactatacaccggagtttcgtgagacctccggtgttggaaaacgccctgtacttactcctgatgaagtcctgcggctcccgctggatcaggcgctcatcatcatccgtggcaagaaggttctgcaggtagacaaaatggattactccaaacacccggaagccaagtacctgcgttcctgcaaagcatctgcccatgtaccggaatggcgccgcttggaagaagaagccgccaaaataccgcagcccgcgccgaaaccggctcctgcagcaaagaaaccggcaaagcgcaaagccaccaaaccggcatcccccacggataaatcacccaaagaggctccggcccccaaatctgccggtacaccggaaggcattatcaccacagacaaggattccatcctgtcttaaacaaaactatcaaattcataggaggttttaatctatggcaaccaagaaaaaagaacttctggaacaggaggctcctgttaccgaaaccgttatgtcggaaggcgaaactctgccggccgatactgctcaacctgaatcccttcctgctgacgctggcgatggtctggatttgaacgaactgctggggcagatggatcagcccctggaggacacctctgccgaagatatggctgaagatccccttcctgaactcaccgaggaggaaatgttcggggatacgcctgctgaaacagacgatcaaagcgctgctcccactgatatgccggaagactctgatgtgcaaccgcctgatgtttacgaagataacgccgacgctgtgcaggaaccccctgcatctcccaagcccaagcgtaccagccgaaagaagaaagaagcagctgctcctgaagaaactgtcacagaggaagttcctgccgaaacaacagagtcggcggatacatccgaaaccatttctgttgcggaggaacctgctgtggagcctgacgttcctgccgtggaggaagctgccgctcctgcccccactccttctcctccccggcgccagccccgcccccagcgcggtgaggcccccgttcttaccatccgcagccgggatgatgtcgagactgccgaagaccgtgatgatgtaatctggcatgagatccataatgcctaccgcacccgcaagatcatcaccggcaagctgggcggcattgaacagctggacaaccgcaagacggtggcagttgtggattacaaggggttccgtgtcattatccctatcaaggaaatgatgatcaatctgggccgcagcccttccggtcaggaatacgccgaccttatgctgcgccaaaataagatccttggcaacatgctcggtgctgacattgacttcatcgtgcgtggtatcgactccaagacccgcagcgtagttgccagccgcaaggaggccatgctgcgcaaacgccagattttctatctggatacggatgctgccggtatgtaccgtgtctatgagggccgcatcgtccaggcgcgtgtgattgcagtggctgaaaaggttgtgcgcgtggaagttttcggcgttgaaacctccatccttgcccgtgaccttgcctgggattggatcggtgacgcccatgagcgtttttccgtaggcgatgaggttctggtccgtattctcagcgtgcggcgcaacagtctggaggacttgggcatcaaggctgacatcaagagtatttccgagaacaccgacagggacaacctgcagaagtgccgtatccagggcaagtatgccggccgtgtcacagatgtccacaagggcgttgtctatgtgcgcctctccaatggcgtcaatgcggtagcccattcctgctatgactaccggatgcccggcaaaaaggacgatgtatcttttgccgtcacccgtctggatatggagcggggtgtggccgtaggtattatcactcggatcatccgtcagaacctgtaagcaaaacaatgccaggggagcagataaaccactgctcccctggctaatttttgtccacagttttgtttcatattgcacttactcaagcgcaagcaatacctctccgagtttcttccactgctctaccacaaaatcaaaagacagtgtatcttcttccgcaaaaacatagttacgttgcatattctgatagtccttacgaagtgcttcattatcagaaaaccctctgagcaactgaaaatcagaaaacttcttttccgccagatcactgcctgttcttcgggtctcttccagtcttttatatcccagcatctcaaggaatatctgctgattttgaatcatttcctgaatctgctttaagtcgaacatgacactgacatcgtaaagatgttttgccacatcaaaatacattttacgctcataatagaattcagcagcaaaaatcttgtcggcaaaaatcctctctaaccgaatcgtgttaatcataaaagggacaacatcatattgtgaccgaagaatatttcgctgttcttcggtggcataggtgtaaagtatcggttcaatttcaagtggtgtaaaaggctcgctgacagtaaaagatgtaccttctactttgacatatccaaaccgttggagcggatcatccgtgtcaatgcctacaagtggagtgtaatcatagacagttgtgatactacctttccgatcatcttcgagatcctttctggatgtgcgtggcaaggcctgatatttctttgttgccatctccagccgtttcttagcctggctgttactgcaattatcgatgcacaccgtcaagtcaatatcctctgaaaaccggcggatacttttctgtgctttatacagggctgttccacctttaaaataggctggtaatgttacctgtttccctgccaactccctcaacagtagcgtaacataatagtccttctccaaaatatcagcccgaatgctactatcctcatggattaaattgataatattcaaaaaagcaaatttatcctcgtgcagtttcataactaccctccaataaaatgtctatggtccgaagcaaagttttttgcccataatattttctggccatcagaatcaacatctcagttttcaatgtaaattcctcaacagtagctcttaccacatcaatcggctttgcagtatctactggcgccatatccagttctctgattgcatccaaaatttgcagatatcgaaaatttccagaattaactacaataggcggtttccgaatctcaatctgcattccttcgggaattcgttttgtatgcaggttggttgcaatgcatctcctttttggcatttgagaaacaagaccaatacgatttaatgcagacaaccctgtttcatatccaattatctcgttttctttccgaagtaactgcttacaaaaaagtgtttctttatctggagtataatatccaaatgctgtttttactctcctgcagtaaattcctttggttaggcgcataatctgcccctctttttcaagccgagccatatttacattgactgtcttttttaccatcgctgtatcaagtaaaagccgttccgccacatactctgcgacttgttcggttgtaattgtttgatctggctccagagcagtcagatactgcatgatcaaatcccggtactttatcttttccatacagatctcctttctgttgcgcttgttattataatactcatttttccttcgttttatgtattcataataacactttttcttgttgcagtcaatgggaggaagaaaaacagatatactccaagaccagcttctcattttcagttagttttgtcgctgttgccccctttagcacatactatcagtatatgcgtctctttctaaacttcccaatacataattttatcttctatatgcgtttatttttcacgaaaatacagttataatatatataatcgaggatttaggaggcaattttatgctgattcagtttcgtgcagagaactttctctctatcaaaggcagtgtcgtattatccctgcttgccagtaaggataaagagcatccgaagcatctgattgtgaatggaagcaaacggtatttgaagtctgccggaatttacggagccaacgcttccgggaagtccaatgtccttcatgcattctggttcatggtaaattatgtgctgacttcgcataaccagcagctccacaaagccatcgaacgttcgcctttcaagtttgaccgtgaaacacccgtccgccccagcagctttgaggtcatcttcaccgcaaatggcatccgatacgcgtatggcttttcggtaacagacaaagttgttattgaagaatacctatattactatcccaatggcaggcaggcgatcatttttgagcggcaaaacacaaacgattttcgttttactgttgatgtcgatgaacaaagcatgctcaaaaatcgtacttcacctaacaagctctatctgtctgttgcatcaaactggagctattccaaggtaattcctgttctggagtggtttgcttcctgccggatcatcacgaaacattctgctgcagatgcttatgaacttgaagcagaacagctcaaagacgatggctaccggcatatgatcgcctctatgttgcgtcgcgcagattttggtatacagtcccttcaaatgcgtgatttagaacccgccacttctcagcagggcgatattttcaccaatattgaggccattcacacggtacaagacacagagggaaatacttcttcctacacactgaatatggcagaggaatccgatggcaccaacagttatttcaaactgattggtgtggtaaaaaaggtgctggatgaaggaacactccttatagtagacgaactggacgctcatctgcatcccctcctgacaaagcatctggtctcgctttttaacagcgtggagttcaatccaaatggaggccagttgattttcacatcacacaacaccaatcttcttgacttggatgtgctgaggagagatcagatctggttcaccgaaaaagatgaactgaccgctgctaccgatttgttttccctccaatctttttctatccgcaaagataccaaaattgagaaggggtatttgatcggccgttatggtacgattccttttattaagggtgggctgtaattggcacaaaattgtctctacattggcacagtcctgccctttcgccgtaaatccatatctgttatacttggtacagtcaaaactttgcatagcagccgctccggtttggagcggctgttttcaatttcagtaaaggtggtggtttctattctctttcaaaaagcccggaaggtgctgaacaacgagcggggcgaggccaactatttcagtacggtggtcttcatcttcatcgctgtcctgctgctggccttcattattgacctgttcagcatcatttccaccaagcaggaacttgaccatgccgccgatcagatggtcaaacagatccagctttccggcggcgtcaacggcgagaccgatgagctgtttgaatttttgagttctcagatcgaaggagccgaaaatatttcctactccattgacgctacctacacatcacccaggccatccggtatgacaaatgccatccagttgggcacccccttcttcattactatcgagggagatgccaaactgggcgggttctggaattttgacctggtaaacattacagtggttgcccgcggcagcggcgtcagtgagcactactggaagtgaggtgacctatgaaacgcatattcctgcgactgaaacagccgctgcgaaacgaacggggcgagatcacctttttcgcctgcttttttgtagtaggcatcgtgatgctgatttccttcctgctcctgtacgcttccatacggatcacctgtatcaacatccgcaacggcgctaaaatggagttaaataaccttagcggcacgatttatgcagatacctaccgttcccagcgtgaaaccaactttgaagagtacctaaataccctttactccagcagtgactataccgacatgctggaggctacagtggcaggcggcctggactccaagattccgctttcaacggaggattacaaggtttccgacatcagcctggagttcaatgtagagaatggacgggttgagtacatcttctactgtgatgtggaattctatgtgcggatgttcggtcacagttatccggctatcacccaacgggtggagctgacaggctaccacaacacaaaattctaaccatactgttgaaagcccggcacgttataccgtataggctttatataacagcaaaaaaggagtgtatgtaaaatatgaaaaagtttttccaatccaaaggctttattgtttcctcgctggctcttctctgcatcactattctgggcgtctgctggttcgtaagccgcgaccgtaccggagatttcagaccagatgaatccccacccagcagcgtcaccggcgattggtcagatggcggcacgcagacagatggtgataatggagcagatgcttatgcccccggccagtccacagacgccgaagaggaatatcctaaagtaacctcccaaacggaggatgaggttgtgatcgactttaccgataccgaaaagcctgaagacacgcctcctccggtaccggaaggtaaaaccgaaatcaaagatcctggtcaggagcatgctgtcaatcccgacccatcagttccggaagtcactgccccgcctgccgagcaaacgccgcccagcaatgaaccggctccaggctccagcaacggaaatggagctgtatacgatccggtgtttggctgggttgttcccggagatgtacagcagtccaccggtgacagcgatggcgatctgaataaacaggtcggcaatatgggctgatttactacaactgaatatggcactacttggccgtcacaggattgtggcggccttcttattttcaaaaggaatggagcgtgatgtatttgaaacgacttctcgccttcctatgctgctttgcctttgttttctgtctattcccctcctctgcctttgcaacgggcggaaacggaaacatagatggcggcggtggcagcatgggtcacggcacaagcagcaacttctggaattcaggcaatgatggtgtccgcattactgttgttgacgcatccagcggaactgccgtatcttctccgctggacttttcaaaccggacgcagaagaccagtcttctccattttggcaaagtcaacaaactgcaatacctgggcggcaccggcctctccctccagtccggcgttgcctattcctgcattagacctgcacaatctatgcccacaatcgtcagcagcaaggggcagagcaacatcgaagccatcaaacggtatttctgttctgaatatgcgtgcatgatggtcgctcaggcagccggagtcgattatgcgcggatgattgccggcgagtacaagctgctgatcgagcccattgcctatttcacgcacaacggccagtattactgcatgacagctactgaagccggcttgtatgatcagatgtccggcggcaatctgcgaaaaaccatgacctcacttacccataaaaacctgccgctgtcaatgttcctggaattcagcgaccttggcatctccgcctggacaggcagcaccactggaaagcagaacaattccgacatcatcagcacccttggcgttggtatcgtctggtttgatgaagctccgccggaaggagaaattgaggcccctgatgtcgaataccgagtagatacggatgtgatcaccgccgtcacactgcggacagatcaggatctgacgccggataatccggcatcggttaccttccatattctcggcaccacctaccgggtcaatgatatagtgatcccagccggtgacagtcaggtagtctgggtcaaatggcataccccctccaccccacagaccgtgaccattacagtatctgtcagcggcgcctataccgctcaggatacctttgtcgcaaaaatcgtggatctgaatgagcacattccacctgaccctgtggcaaccgacacgaatcccggctactctgtgccgcccctccccagtgaaacgcagaagctcactgccaactggggcgtctggagctgctactgggtgcctgtatgggtatggtgcgaccacggtgaagatggcgggcactgggtggatgaaggatattgggaatacgaatatacgggctactccgcttccatcagcggcgagatgtccctaatgccagacgatattgtacccacagcatccggcaagacgatgaaaagcgggtacggcgttaaaaccgaagtgcgggcaacgctgtccacagatgccccgaccagccacattacttatccccaaactgctttttccgtatttcctgagttccagtatcagacctatctgcggcttctgcagcgttccggcggccaaagtgcaaaattcatcttcaagcccaacgagttttccacctatgaccggacagtgcatttcacaccgctgtggttccccgatgccaccgactacaccatctatacacaggtgtgggatacctggactcgtgcgactcgttcgtaactgaaaaggttacgcacaagtctgcattatcttttataaattttatgtaatgcagttcttggagaactgatatttcaatgagtggaatgatggggtaacgccctgaaacgctcaccctgatactccgatatgcgttagcttggcaaaaagcaaagcgtataaagctcggtgaagtcggctgaaagctaccgtaacttcaatataatttttttggaaacgaaagctgcccagaggtgggtggtgtagccgataggtcgggggtctataaaatgcctatggttagaatgtgttaatcaacactgacgaaaatccgaatgtacgggtctataaggctgaacatatagaaatgtatgtgaaactacggtttggcatatggggtaaagtaaaactgtcgtcctatgaaataccctataccgttacaggcggtatcaagtatgcaggctcagaggattacctaagggcaataatgtaaagataggaatatcggaacgaggaaaggtcagaacgcagagagtttgtcctctatgaagcggtgtcagggaaagtgattttcatataacctgattttatctgactgagagtagtggcacgacctgtgaagcggtgataataagccgtggaggaatagccacaagtcaccaaaattacacaaaaaaaacaagcactaacaaatcaaaggttcgagtatgactaagaaaagcaaatccagaatgaagggatttactgactttgacaggattgcgaacaccgaagaaagcatatctgcgaaatgctgaatactatgactttcaaaatgtacttgataacctgtatgccttaagcaagaaagaaatgatatttacggatttgatgaaatatatcagttcggaacaaaacatcaggctggcatatcggaacattaagggcaatacagggagcaggacggcaggagcggataacaaaacaatttcccatcttgcaaaatgggagatatcagcactgatacaacatatccagaagaaactgaattactaccaaccacaaaaagtccgcagggtggaaataccaaaaggaaatggaaagacaagacctcttggaataccaaccattatggacaggctcattcaacaatgtatcttacaggtattagagccggtttgtgaggcaaaattctttgagagaagcaatggtttcagaccaaacagaaatgcagagcaggcaatggcgcaggcttacaaatgtattcaaatacagcacttatacttcgtggtggatattgatattaaaggattcttcgataatgtaaatcacggaaagctgctgaaacagatgtgggctatgggtatcagggataagaagctattaacaattatctcctgtatgctaaaagcagaggttgccggaattggtttccctgacaagggaacgccacagggaggaattatttctcccctgctatccaatatcgtattaaatgaattggattggtggatagcgagccagtttgaacgaatgcctacaaagcgtcagtacagtcagcaaatagcaaaaaatggaactgaaatcagagggcatgtttatagctccctgcgcaagtataccaatctcaaagagtgcttcatcgtccgttacgcagatgattttaaaatattctgccgtagtaagaatgatgcggacaagatgtttattgcgacaaaaatgtggttaaaagaacgattagggcttgaaatcagtcctgaaaagtcaaaggtggtaaatctgaaaagaagctattccgaatttttgggatttaagctgaaagctaccccaaagggcaaacagccaaacggggaaacacggtatgttgttcaatcaaaactaaatgataaatcaatgaaagagattgcagaaaagctgaaaagcggcattaaggagattcaaaaacctgcgaatgacgcagaagaatacaaggctgttatgcggtacaattcaatgataatcggctggcacacttattacaggattgccactgatgtcaaccttgacctaaacaaatatgctttcttagtacaccgagccttaaaaagaagattgaaagaccgtttaaaaagaacttcagatgttccattgtctccgttcctaaaagcaaagtatggaaagagcaggcagttacgatatgtgaaaaagcaccctatactccccattggctacatcaaacactcgaatccgatgtttaaaaagaaaatcatcaataagtttacagccgagggaagaacagaaattcataaacagttagaaaacattaatatgggggtcctgcattatctcatgcttaatcccgatatggggaaaagcattgagtacaatgacaaccggctgtcgctatacagcgcacagcagggaaaatgtgcagtcacaaagaaaccgcttgaacttggtgatattcattgtcatcataaaatctcccgaaaactgggtggagatgacaaataccaaaatttagtgatagtcagcgaagatgttcacatacttattcatgctacaacagcggagataattataacgtatttagggaaattgaaacttgataaacggcagttaagtaaggttaattccttgcgcaggcttctgcaattagaagcaattaagcaatcttgaaagttatgtgtattgtgtaaatgaattttggtgatggagcgccgtatgagctgaaaggctcacgtacggtgtgggtcgggggaaaaggcggagataatatcaaggtcttacctatcgacatctgacggcatgttatccatcaacctaaatgactatgtttcaatccaagggagcctttatgatgactggtataccaatcgagaataacctctggacagctttcctgcttaccatattttttgtggtggccggctttgctgtctacgatgtgctttacagacgggtgcctgaccgggcactcgtcttttttatccccttagctaccctggcgccggtcctgcaggggtatttcctgttaaatcatgggctcccgccgctcttcctctggccggtcgctacccatgccctggtaggcgccctgctcggcttttgtattccattggcagctgcactggcaacaaacggcaccggtcttggcggcggggatatcaagttctgcgggatattagggctggtctatggcccttccggcatggcgctggtctttctgactgccgctgttaccgcaatgcctgtaatctttcttctcaggcggctttatcgaaccgggcagccccttgctatcccgttcctgccatttctcgcctgtggctgctgtacagcgaccctggcccaactatttttaagcctgcaaataaaaaatcaatagtaaattgattatttcaggcaaaaagttttatgtaggaatttgaacattgaaataagaccaccgatattcgctggtctgaaataaaggtatgtatgagatgactatttcgaaagcgatgaaagatattctttcacccgtccatagtagatgcgaagaaacttattcgccccagcagtcatgtagacatagtaaggtttaccctgcgaccgcttcttgtccataaacagataaacagggtcatcctgtggtttggttttgataagggcatccattacctggaataaggttttacgaagagtgccagaacctcttttggatgcaggaacacttttctgttcgtaagaaccggattcatttacgccggggtcaacgccagcgaaggcggtgatagcccctttgtgagtgaagcgggaaacatcaccaatctcagccataagctggggaccgagtgatctaccgacacccttcatagccattacaataggatattcaggcagtttggaggcagcttcattcatcatagcacgaagctgttctacggtctgagaagccgtatttaattgctcaacagcctgtttgacaattagttttgtcaaatcgtcttttggaagtacagaaacaatctccttggatgcttcatagatttcaacagcttttgactggctgaagttgtactttctacgtttgcaccacttttgatagtggtcaacaaatgcgttaagcgacagtttgcgaacacaatccacatgccaataggtggtagcaaaatcaacccacttctggcttccgtcctcccgggcaggactatcaaaataggtatttgcaccgggataagtttggtcaaggatgccgataaggttgttcttcatagcggttttatgtttcatgtaaaagtcaaactggcgattcatgattttaagctgattacgaatctcgtccatgaaactatactgtctgagttctgtccaactgtcaagagtatagcgagcaatttttaaagcatctgctttgtcagacttcactttgcgaagggagttatctccaaagtctttgataagtttgggatttacggcagatacgaaaaggtcagcctgtgagagttcacggacaatgggttcgtaataacgtcccgtatgttccatcacaatgcgtgactcaccatcaatggcttgaatgtgttcgataagagagcgaataccgctgactgtatgcttgacttcaaatggtgtagaaacaatttcaccataaggacgaaggatggcaaccatacttttacctttagaaacatcaataccaactgcgttcatgttcataaatttgtcactccttaagacttatagtgcaaaagataaataccaactttactcattgcctattcaatctactgtggtgtgacacgaacgcacggaaagtggttcaacctgcataaaacgaacgctgcgaatgaggagctggttatcagtcttaaaaacggacgtgtaagtccaagaaaggaagccgatataccaattgctccatcattatacagcttaagcaataagatggctaacaacctaactggttgttaagtgcattaaccaatttatattgtagtagataggagacaacgcttatgaaactgaataaccgattcatcttcggtatcctctctctgctgttggcggcagttatcgcctttgtggcacttccaaccatcgcccgtcagaccaatggaaaagaggaaatcgtccgtatcacccagccggtattgaaaggcgagcaaatctcgtcagaaaatgccgaggtggttgaggtaggcggctataacctcccctccaacatcgcccatcagctctccgatgtaaatggtctctacgctaccgccgacttggctgtgggtgactatatccttaccagcaagatcagttctgtaccggtttcgtccgatgtggcgctcaacagcatcccttccggtaaggttgctatctcgctgaccgttaaaacacttgcttccggcctctctgacaagcttcagcccggtgacatcatccgtatttaccactttcttgatacggcggccgaagtaccggaactgcgttttgtcaaagtattgtccgtcacagactcagacggcatcaatgtggataatgccaaggagcccacggaggatgaagaaaagcagcagtcagccaccatcactgtgctggcaagccctgaacaggcgaagatcattaccggtcttgaaaatgacggcgtagctcatgtggcccttatctcccgcaacaatgacaaactggcagatgagctgcttgccgagcaggataagactctgcaggaaatctacttccccgaaactttgattgaggaagaagcggcagatgcgaaaaattctgatgttgaaagtgaaccccaggaaacggaaactgcagagtctgcacaatctactaatgaaactgcaccctcggcagaataatcaaatcaaggaaggaggatcttcgttatgggtaaagttatcaccgtctggggaagccccggcagcggcaaatccatgttctgctgtattctggccaaagccctgacccgggacaagcggaaagccatcattatcaatgccgatatgaatgtccctatgctgccggtctggctgccggagcagatcatccagaccaatacctctatcggccaggttttgagcagtgtggagatcgatacatctctggttgccagtcatgtgacagtgctgaaaaactatcccttcattgggatgatgggctatgcggcaggagaaaacccgctgagctacccagaggtcaaatataccatggtgctgcagctcattcatgctgccgccaaactggtagatttcgtcattctggactgcagcaccagcatgaccaatgtgttcactcccgccgctattgaagctggcgatgtggtcatccgtatcctcaccccggacctaaagggcatcaactacctgaaagcccatcaacctctgcttgtggacgagcgcttccggttttctgagcatatgacattcgccggtctggcccgtcccttccacgccttggatgaaatgggctatatcattggcgggtttgacggcctgcttccctacagtaaggagatcgaccgctgtgctaccgaaggcggtatgttcaaggctatcacctactgtaaccccaaatacactgcttcactgaacaaggtactggaaattctggagcaaatggaactggccgagcagtcagaggaggatgcggcgtatgaatgtgaggaggatgccgatgagtaatttgaatgatatattcttcacaccagccgccaatcaggagctgacctatgaccaggtactggaggatgtacagcggtattttgccgaaaaccatgcctccaccattgccgaagctggggaaggcaatgcagagcgtgccacaagcctgctgaaagaactgatggaacactacattgtcaaacgcaaatatgcccttgacgggctctctacaaaagaactgtgttccaagctctatgaggacatggccggctactcctttttgaagaaatggatctataagcccggtgttgaggaggtcaacatcaacgcctacaacgacattgaagtgatcgaatccagtgggcgcagtatcaagatccctgataaattcagttcgccccagcacgccatcgatgtgatccgccgaatgctcaacgcctgcggcatggtcattgatgatactatgcccagcattgtgggatttctggacaaaaacatccgtatttcagtggacaaaactcccattgtggatgcagatgtaggcgtcaatgcctccatccgtattgtcaaccagcagaccgtcagtgaagaaaaactgctgaactccggcagtgccaccgctgaaatgcttcactttctgactgcctgtattcgatatggggtgtctgtctgcattgccggctccaccggctccggcaagaccacgatcatggcctggctgctgtccaatgtgcccaataaccggcgccttattaccattgaagaaggcagccgcgaatttgatctggtcaagcgggatgcgcagggcaatatccttaattccgtagtacatctgctgacccgccccagcgagaaccctgcgttgaacatcaatcaggattttcttctggagcgggtgctgcgtaagcatccggatgtcatcggcgtgggtgaaatgcggtcagcagcagaaagcttgtccgcagccgaaagttcccgcaccggccataccgtatgtaccaccatccactccaattcctgcaacagtacttaccgcaggatgatgacccttgccaaacgcaagtacaacatggatgactccatcctcatgcagatcatggtagaggcgtatcccatcatcgtctttaccaagcagctggaggaccgttcccgtaagatcatggagatcatcgagggcgaggactaccaggacgggcggctgatcgcccattccctatacaaatatgaagtggaggacaatgtaactgatgaccgtggtgaaacccgtgtggtagggcaccataaaaaaattggcttgatctccgattccttgaagaaaaggctgctggacaatggcatttccaacaaggaattggaagaattcatgcagccgccaaaggaggtgggttaattgcaatggatctatcttatctgttttatcctgctcagtgctgggcttttggctctgtttggtgtgaagccgggtgattttatcgacgccctcttccgctcccagcgaaaatccgccaccttgtcggatgaactgaatgttcttctgggcacaccagccaagggcttttttaatcaggattacgaactgaaacagatcttgaagggtaccggacgggcggaccgctatgaggcaataaaacgactgtccctgattctgttcgctgtgggggctgtgctggctcttttgattgggaatgtgtacatggtgcccattctgggtatcggtttttctcttataccgatctggtatctgcgcagcactgccgccagctataaaaagcacctgaatgaagaactggaaaccgctatttccatcatcacgacttcctacctgcgcaccgaggatctgatccgttctgtcaaggaaaacctgccctatatcaatgagccggtaaaagccaactttgaagccttcgtttatgaagcggaattgatcaacgccaacatcaccagtgctatcaacagcctgaagatgaagattcccaaccgggtcttccatgaatggtgcggcaccctcatccagtgccagtccgaccgcagtatgaagaatacccttcctaccatcaaccagaaattctccgatgtgcgtgtggtgcagtcggaacttgaggcaatgatgcaagggccgcggcgtgaagccatcaccatgatatttctggttatcgccaatgtgccgctgctctatttcttgaatgaggattggttccacacccttatcttcaccacaccgggcaaaattgcactggcgatttgcgcagccatcatcctatttgcgctgacccagatcatgaaactgagcaagcccatcgaatatggaggtgatagcgtatgacttttctggcgctcatcgccatcatcttcttcagttttgctgtctacaacctgacctgcgcctttgtggacatcccgaccaagaagacctcacaaatgatgatgctctcccgcaaacagcagggcaccaaaaacgaaaagctgcttgatgtctatgtgacaaaaatcgccggttggatcgccccttatttgcggctggaccggctcaagcgcaataaggtacaacgcgctctggacattgcaggtctgcagcttaccccggaggtctatacagccagagcctgggtaactgcaggggcagttggcctgtgttccatccccatggcacttcttattccgctgctggtgcctattttgatcggtcttgcagtggcgctgtggttttcaacctactatgcagcctttgattttgttaaaaaacgccgcaaactgattgagggcgagattccccgatttgctttgaccgtcggccagagccttgaaaatgacagggatgtacttaaaattctgacttcctaccgccgtgtggctgggaaagacttcggcgccgagctggatcagaccattgctgatatgaagaccggcaactatgaaaatgccctcattcgatttgaaacccgcattggcagccccatgctgtccgatgtgatccgtggcctgattggtgtcctgcgcggtgatgaccagcggatgtacttcaaaatgattaccttcgatatgcgccagatcgagcagaacaatctgaaaaaggaagctgccaaacgtcccaaaaagatccagcgttactctatgatgatgctgatttgcattatgatcatctatctggtggtgctctgtaccgaggttatgagttcgctcggggcattctttggctaatcggcatccgccacggtacttccgggcgttttcatacctgctcctcatatggaagacagatacacagggaggtgagcgtttgtacccaagcgattttccatagcgacaggcacaccattctttttcatctggactgagccggactgtttcatcagcccggctccattttttacaggagaatgcctatgcccaaaaagaaattttatccgccgaatgataccggcaccaaaaaacgacgctttcgttgcttgctgttccaacggcctaaagcatatccgaaccggccccgttccaacaaaaacaatctgatcaagcctatccgccgcgcttaacagacggtggacttgatataccatccactcaatcatcaaacatataacaggaggttacccatgagaaaattcacgacccatatctataccaaagccaactatctgctcaaccgcggccgtatggcattgtccaatcagcgcggcgatttttacatttcggacgccgtcaaaatcattatcgccgtagttttgggtgcgctgctcctggcggctctgaccctcatcttcaatgatacggtcatcccccgcatcacccaggagattgaaagtctgttctcctaagcaccaaatcaggggccagtttgcagaacttctgcagctggctcctttttttatttttagaaatgcaaatgtactgtaacggaggtgaaagcatgaatcaaaaaccgtgtcagttctattcctttctgcaggcagtccggggtaactggcgtaacgccctgttcatccgctgcagcggttcactttgtccaataatccggcaggcatcttgtgagggattcctgatggcagcagacgcaggctgtcagccgatctttctgtccgtccagacagtgcggaagctgagtggagaagcagtggaccccgaagaatgctctgcaattctggagtgccgctcgtttcggactgcttataccaagtttctggaatggcatacctcttcggaccatgtatgtccgtttttacagctatgcccagaccgggatacctacttcggatgattctgcctgttaagacgcaatgccgccgtcatcggcgcgtaatggaggtgattttattgaaacaaaagcaaatcaaatgtccttattgtcatgctcacgcttctcttcggcctgcaagccttgtgtatggatctactccacagaccagaggaaaattcctgtatgtctgcgacagatggccggcctgcaatgcctatgtcagtgctcatgagcgcacattgctccccatggggacactggcgaatggcgatctgcgccacaaacgcattctagcccatcgtgccctaaaaaaactgcagcaggactgccatatggaaaaatgggaagtctatatctggctgcaagccaagctgggactggatgcacaccagacccacatcggccagttttccgaatatatgtgcgagcaagtcatttccctctgtcagcaggctccggcgtacacatccgggcgtgctgcctgaacggaggtgaagccggatgaagcaaaactttaagcttaccaaagaccagcagacactggtagaaaaaaacctgtccatcgttcactgggtcattgtcaacaacattcatgtgaatcccggcatctgtggtctggagtatggagatctgtttcaggaagggtgcctgtggctctgcaaggccgcctttacctaccatgccggacaggcacagttttcaacctacgccaaaaaggttgtgaaaaacggaatcctctcctactgccgcaaaatctgtagccagggacggcacatcagccggctgatcatcggagaacagggcgaactggctgcagatggagaacagatagaccagccagacgaccattttgactcccatctttctcgtctggagacccttgatctgctggaagccagcaaacagaactatcagggcgttgccagacttggcatcgaagcgctggcgctgaaggtccagggaatgcgcattacagacatcgccgccctctatcaagtccctccttcccatgtgggtgcctggatttcccgttctctggaaaaacttcgcaatgaccctgactttttgacctgcctgctttgatttgttgaaaatcagcatcaatatcagtaagggatatgtataaaaaggaggtatcgaaatatggcaatcaaaaccctatacactgcggtcggccggtttgagagaaggacaaacggctgcaaccgcagttgtccaatcatcctgttaggcggtcaagagtacatggtcgatatgcaggaaatggtgatttggagcatgctcaactggagaatcctgcgctgggatgacatcgcacaagaatacgaaaagctatccaccgcatccggttactgtaccgagcggtcttgggaagactgtacaaaccgcctgctgacccgtggccttctggtatccggcagtggtgaaacagaatacgatgctctgtatgacctgcttggctcgctcagcattatcccaaccagcggaccgttcttcctccggctcgcctcttttgtcaagctgacgctgctggcacatgttccggtatccgccgcgcggaaactgttccagaaagataaacgcaccaaatacgaagctctggtcatgcgccttgccggacaagccctgctctccactgctgagatcatcaagtgcatagataaaaatatttcccgtctccccaatgaatgtgcgcttttggattccctctacggcgatgaaacgaccaccagtgacaacattgccagcatggtcaaaatcagccagagcagcaagccggtgacattagccgttgccaatctttatctgcggcagcagattatctttgagagggtatgagcatgatggaacaatggactctttttcccactgtattgcagagaaagtttctgctcactctgctggccggaatcgccagtgcgggaatcagcgtcatcatctgcgtggcgactaaagatcatatcctgctggcattgggaattatcgtactctgcgcctgtcttatatcctgtagaggaatctgggtgactgcggcacataagaactacgaagtagtggaaggcatctgcgccggtatcagtacacctatgctccgccgctaccgcaaagtacatctgatagacagccatggcgtagagatcacactgcttctcagtaaatcggcccggcttaaaataggcgaaccctaccgattttactttcagaaaggggcacgacctaccgttggaaatgactatctggatgccgcactttcaacgaacagctttttgggctatgaagcaatcagcgagccgtagaaagcggaactgaaagatatgactgacatccccctaatgttttttgagggaacagaaatctatttatattgcaatcattttacaaaaaggattcaactccttgacaaagtgatgtataatgtactttatgtaaattagcatcaaggagttttagagatatgaaaaaactaatagaagtatcattaaaatctatcattttctttattggatgggcaattttcgtatcagttataccgattcctgatattgacaatacagcgttgtggaggttttttgcagaactaataccgtttttggcgattgttattatgaccgtcattttttggtttgtagatcgtaaaaaaaccaagttacatctcacacagcgccccgtctatagcagtgtattaggagggacagttggactaagttggttaggtatatctgtcggtattttgctttttaccgggtctgcacggatagaaggtactaatcatatttctatgctctggctctggatactatcagcctttatcaacacaattatgcaggaaatgttggttcgtggttatctatatcagatgataaagagaaactacaatgtagttgcggcaactgttgtgtctaccatgctgtttacttttgcacatggaggtgcttttgaagcaggaactctccctgttttgaatgttttgacaatgagtttgtttatgacagcagttttggaatatacaaattctttaattgcccctataatcgttcattttctctggaatagtgtaggagcgattattttgggaggagtatcacttgcagaggactatccacatttgtttaatatgacattcggtggcaatcaactgctatctggtggaatttataaaattgaaggcagtgttgtagtatttgttttgaatgtgattatgataattggatttattatggcaaagaaaaagaagaatattgcataagaagtcacaaaccaacaatcatgaagttgttttgaaatgctccttttatgatgacagtttattttcactgtctcccataaagggagcatttcattttccttatattttgcagaatacattccttccgtccctatttattaggtagataaaagaaaggagggtttcccatgtataagccccacaccattgaacaatacaaagtctatcgctttctggaagaaaactttgcgctggagcatttcctgctcgctcctttgtcacgcttcggactgatgctggaggacaaaaccgatgagaaaatcgcgtttgcctttctcaataactgtgtgcaggaaatacccgtaccagctccagccgatccggaaacggtaaccgcttttctaaaacaattccgcagccttacgccccacccagtcatccatgactttgaagcgctgacccgctggtggctggacaatcccaacccgcttacctaccagcaggcgcttggtatgtccgatgatctctaccgccattttctgtctcatcctttgatcagtgaagatgaggcccttcggctggcacgcaaaggactcgttaccgaatcggaatataatgacctgcagctatggtatttcaacggccatacaatgtcctgctggtttggtcctctgggagtagatggcaccggcagcctatacggtctgacctttgactatcaaacggcatccccaacaaagactcaattctaccttttggatgactactaccgtgttatgaaccatcttacagagtaagaccttttcaactactacatatcgtgcttgtcactggcaataaatctatatatagtgttttatatcttgacagacacaagatccagtgctatactgaacttgtaattgatttttgtgcgtatcccatttgggaatacaggtctttttgatctgtaccgtaggccaaaagcctgcattgcacacgctgttaagtttgtatgcaagtgtcagtgattttttgcgcccttttagggccgaaaaactgctggcacttttttatatagataataatgccaatggcagaaaggagtgttatggcacagatttttgtgttcgggcgcgtcatgaacgacctcgtacccaaagaaagccagtccaaacaaagctatgtatgctttgatctgatggaacgcaccaaaaactggacgcagttctatcaggtatgggcctgggatgcagatgtcacccggctcatgcaattcaaggtcaaaaaaggcagtatgatctggcttgccggctcacagcggctggtagatgttcgcatgaaggacggtaaattggaaaaaaaactgaaggtcagtctaaatgactttggtttcctccccaaacagcccgccacagcgaacagacaggagaatgacccggacattactgcggaacccgcaccgcctcccacagaggtattggacggtgaccgtgaatccctgccggagtagtttacttcggcgcccaagagggaccgtatcaagtttttcagaatgaaactgaaagcttggtgcggtccctctttttttgttttccaacaaattcagaaaaaggatggtatcaaacatgaataatgacagaggacttttgagtggcagcatcacgatcctgattggtgcggtcatcgcaattatggctctggtacgcgggccctggcaagtctggctgcttctgggcgttttcactctctggggactgtgggtagttttgatcctgcttctcccctatatgcagcaggctaaacggcatcgccagcgtcagcagcgcaccagacaactccatgcagaaggcatccaaacaagaaattttgaaattcctgacctgggcagcaccagctccgatgacctgctggttcgccacaccaaccatcgtattctggcatatctgcgctccgcttatccgcaagccaccttcgagtggtgtgaaaagcagccggagcagctgatccgcaatggcggtaccggccgcatccgtgtttttggcattgacgagtttgatcacgctgatgtgacactggatcagaacgccaatatcaaatgcgatatggtcaagatcgttccgctatccaaggtcggcggagaaaccggtgaggatgatacaacacctccgaacaggcagcccgttgatccccgtatctggtatgaaacacagggacgctctgtactggaaacactgatctccgaccttaattcccgtgggcacagcaaactgacgcttcgggaagacggtgatatctgcattgagcagggcgaagatgctgtttctcaggagcatctgaacaactttccccagaaggtctactggccccgtctggcagaggtactggaaagcaatggtctggccgcagaagtcactgcccagggcattcaggtgtcctggtaatgcttctgacgccaaggagcgaagagaaaggagtgaacttgacgaatgaaatcaggacttaccatcgtggaaatggcacagcagattgaacgccaatccaaactcaagcaagactatttgcttgataccagacggcttcaagtagaaccttttggttctcaactttatctccatacctttgatgaccacgatgacccactggtagagccattggagattaaccagatcgcccatcggcagatcggcacacatctgaagattccggctgcttactatgaccgtatgctttccgattatccagaactgctggcggagaatgtgaattcctggttccagcgggaaccgacccagcgtatggtccgcactctggatggcactgtacgggcgtttttgagcaaccgctatcgccgcattgacaatctggacattgcagaaatcgtcctccctgtcattcagcaaatggaggacgcctattttgaaagctgccagatcacggacagccgtatgtacatcaaggtagtcaacaagcggcttgaagccgaagttgtacccggtgacatcgtacagtccggcgttatcatcagcaatagcgaagttggactgggttccgtcaacatccagcctttggtctatcggctggtatgcagtaacggcatggtcgtcaacgatgcccagactcgccgcactcacatcggccgggtcaatgaggcagatgaaaactttcaactgttctcacaggagacattggccgctgatgaccacgcatttgccatgaagatcaaagataccgtgatggccgccgtggatgaaacgcggtttacacgggtagttggcatgatgcgtgaagccacaaccgttcagatgaataccactgatattcccggcgttgtccgtctggcaagcaaggatttcaatatcaccgaggaagaaagcaccggcgttctgcagcgtctgattgaaggcaaggatctgaccctctatgggctatccaatgccgtaacacgctttagtcaggatgtggacagctatgaccgcgccactgccctggaggggatcggatacaatatcctgtccatgccccgacagcagtggaaccgtatcaatcagatggccgcctgaccatctgcaaccatcacagtttttaaggaggaaccactatgtataatcagaacagcgatttgatgaaacaggaaaaattcatgctccccactatgatcgaaggcgatttcagcgccgaggaactggctgaggacgccgatggtctgcagatgagttttcagcgtgtcaagattcccgccggcggcacactccagtttgagatgccgtccgatgatccggacaatcccgactatgaaaagaatctggtaggcgtcattctgcataaccacgccacctgcgcctactggccggctggcagcgaatatgacgacgataccacgccgctttgttcttctgtggatggcaaggttggcatcggcactcccggaggcgcctgtgctgcctgcgtgatgaaccgctttggttctgcacctgatggcagcaagggaaaagcctgtaaaaatatgcgtgtgctctacctgcttcgcagtggtgaatacatgcctctgcaggtaaatctgcctcctaccagcatcaagcccttcaaggaatttctgaaccgggccttcatgctccgccgccgcgccacttacggcagtatcgtgcagattggtctcaagcgtgagaacaacggcaccaatgactacagtgttgctaccttcaaactgctgcaggatttccagggcgaggagctggctcagatccgggcttacgccaacagttttaaggagcagatcaaactcctgctccagcagcgtgccgaaatcactgaggagcagcgcgacaccggctgcgattatgtaatcgagcctggcgccatgaccaacgagccggcagatggtcactatactgtcagccagatcaatggtgactgcgaacagctgcctgcataagtatcttgatgtggtttgtgccacatgacacataaacaaagggatgccttcggtctaacacaccggaggtatccctctttttttatttaaggaggaaaccactatgttatgtgaagtaccattaaacaaagaacagcaggcatttgccgccgatcatcatggtctagtctacaagtttttaaatgaaaaccgtctgccggaagatgagttttacgatgtgatcatttttggctatctccgagcagtgtatcgctatttcaacgagcccaagcttcagaaatactccttcgccacaatcagctggaaatcaatgcagggggctttatctaattacaatcgataccaaactcgccgcaaacgcaatatggaggttctcagtattcatgtcgggttatatcccgatggtgcccctttagaagataccattcctgcccatgacccaatcatgcagcagttggaaatggaccttcttctccacgagctggccggcagagtatccaagcagcaaatggatattgtgcatctgaaacagggcggctatggcatccgtgagattgcccgcacccagaaggttcctatgcggcgcattaaagagttgctggctgaagtccatgatgtgctgctggatatttgctatggatgaacccattacagatacgaaatacccttacatccatattttcaaaaagattggaggtcaaaccgaatgaagaaagaaaagaaacagatcgttttgaatggttctctgctgcgtccactgtctgttgggcggggtgcgattctgcacgccggaggaaacatctaccacacttcgcgtgtggtggcgattctggaggagtcggaggattgcgtccgttttgaaacgcagaactcccactaccatctctccatgtccccttttccgctggcggctgtcagtccgctccctgtgagattggccgcatgtgcgtgaagggactgtaaatggattggaacagccagctcccgctgactattccacaagttctggccgtggcggataccattccgtcacggctctttttatggaggaacaaaatgaacgaagaaatcatgaatgatatccaatcagtccgccccaaagaccagttcaccttttcctgccgtcaatgcggggcgtgctgccgcaatatcgaaggctgtgtaatggtggaaagtctggacgcctaccgtctggctcgctatctccgaacaaaaggtgagcccatcgaaggaatagaggatttcctgttccgttactgcgaaccagaaccactgactgaggaaggcttccctatctatatgctcaagacaaaagcccctaacggctcctgcatcttccttacggatgggcgctgttctgtctaccctgcccgtacccgtacctgccgtatctatcctcttaccgtaggtccaggggagcgtggccgcgattttgaatactgcctgtgtctggaccgacaccagagccactttaccggcggccgggtatccgtcaaggactggctgtatcagaatttcaagcgggaagacaaagaatatgtaaagcgggaatatgagatcgctaccgaactgggcaaactgatgcgcgccattgatctgccatgcggccaggcattgtattcaaggtgctctactaccgctattacaattttgatttagaccagccttttcagcctcagtatgagcagaataaccggcatctgttagcagacctgcaccggattgtcagggaacagtaaaaggcaaatggcttttagaaagggggccttattttatgaatttacacgaaacagcaatggggcaaagattttttaatgttcagctccctgcactgatcaacacactcaaagatattgcggcggcgctttctcgccctgcaccatctgctatatcctttccggcagacccacgctttctcacttcgctctattatggcgaatatgaagcagatgtgttcaagcccgataaacgcctcgcaccttttaaccaagcagtacatcagaaagaaaaagctctgcttccgctgctctccaacgaggcgtccatcgcttttgaacagtatcagactgcggtacaatgtcgcaattctgctgtattggagcaggcatacgcctctggttaccgtaccgctgtgcagatgtttgcggcaggcttaggcccacaaccgccagtaccggaacatggggaggataataatggatgagaacagactgcccaaactgccccaggaagcttttcggccaatgatcgcacaatcagtccaactggaacagtttttaggggaagaactgattttttgctttcgggatcttgatggcgttcatacctttactacctgctatggcgatatctacaaaacggtcaatgcactgcgggactatgtccggcttctggaatcggtgtgcgatcagtgggagctgactggattccatcgtgctacctacgagtaccatgcagaaaaactgcgtaaaattgcggataaactgcaagctggtatcggctacgactatgacaaagctgtagaaagatgcaaaaagaaacgagccagaaagtcccacagcaacgatgtcggggaagatgcccttctactgacggtacgggctgccggcaagtccgctgacaatgaaaaggaggctgcgccttatgaggaagataccccttgggaacctgaactcgaataaccctataaaaacacctgttaaaaagtatcatgcaagcgttgcccgacaatcccccagagaacggaatcgattgctggcttgcaagaattttgcgtttacccacgccaatgtgcataagcactgccgccacttccggcgcggatagccgcccggaagctacccatggaggatgcctatggaacgagatgaactacgcaccactttagtgaaccatctggaaaccctgcggcgcaatctgcaggtcgtatccatggaggtgctgaaaaccaagtacaaaaaaccatttgatgtcctgcggcaagacatctgtaaagccgctaccgcctatacccgctttctggtattcgacggtatgcggatcaaacacaaatactttgatgaggccgtaccctatattgatgcagctgtgaagcaaaccaagcggctcaaacagatctcagatgctgccttccagcgtcaggatattgacgagatcgaatcactcgcccttgccctgcgcaaagagatagaagcagctctgcagcccttctatatggggcatatgtgcctttatgtgacgccggaatgctttgatgacccgcccaaaacgccggaaatctacaacgatgcaaccgcctgcgtctggagggatggtacatggcaactcctggaggataccagcaaagggttcctgctctttgtccaatccaaatccaaggaggaatctgccgcatgaaagaaacatcccaacgatatctaaacagcgaggctcacggttatctcatggaggccaaagcctataagcttttgctcaaagacttggagcgcatccgcgccaagctcaggcggcacatcgaaaaggaagccgcagaccgcgaggcagaatttgaagcggccatgcaataccatagcgaaagcgacatccaggaagcctacggctgggaattcatcagtgaacagcagtatgagcactatctggaattgttccgtcaaggtcgcagggcacttgatgaacacagccccactgttacagaactggctctctccatcctgaaccgtatctttcaggatattgatagagactgccgccaatgcgagtttgaagccctgtctccggaagaacagcttgccgagttgaagcgtgctgaggaatccaggcaggcatggaggcagtatatcgccagtctgaaggaaatgatcaacccctccgctgcgcaggaatgacccttaaaatcgctactgaaatttactttgcagactgcctacttgcaaaatcagattttttcggctaaaataggtatataataatatatcagccgaaattaagaaaggaggaacgcctgtgtatatcacccgacacatggagaaaccggtgatggagctgaatgaacagtatcctgtgcttctgcttaccggcccaaggcaggttggaaaaactaccatgctggaacatttgatagaggtcgagggcaaggggcgcaaaaaggtctctttggatgatctgacgctgcgggaactcgccaagacggacccaaagatgttctttcagctgtatcagccgccgctgctcattgacgaagtgcaatacgcaccggaactgttcccatatatcaaaatcatggtagatgaacgccatcagcccggcgatttctggctgacgggttctcagcttttcaagatgatggagggcgtacaggaatctctggcaggccgggtggctctgctccacctctcaccgctttcccagagtgagatcatgaaacggcctcctgaaccaccgttcagcctggagctgcctcttttgtccgaacggcagaacggacgccaaatgctgaacacgccagaggtctttcagcgtatccatcagggcgggatgcctgccctggtcacaggaacctattccaatgcctccatcttctattccagttacattgacacttacatggaacgggatgtgcggcggctgtccaatgacattgacagcttgaagtttttgcggttcctgcgttctgtcgccgccaggacttcccagcaggtcaattacaagggcattgccgatgatgcggagatcgaccagaccacggccaaaaactggcttcatgttctggaggcgctggggatcatctttttattggagccctattccaataatgtcctcaaacgcaccgtatccacacccaagctctacttctacgactccggcattgtctgctacctgacccgttggagcagtccggagacagccatggaaggagccatgagcggcgcactactggaaaactataccgtagcggaaatcatcaagacctatcagaacgccggtcaggagccattcctgtactattaccgggataaggatgccagagaaatcgacctgatcctggagcgggacggaaaactgtttcccatcgagatcaaaaagatggcctcgccgccaaagaaattgacgaaggtatttgacctgatcgacaagtccccactgcagcgcggcactggtgctatcctgtgcatggctgaccagttgggcgcttttgatcagaacaatctgatcgtgcctatctctttgatttaacgaggaaccctgccgcattacctgcggcttataaccgaaaggatcgacagactgcatttagcggcctgccggtccttttttcatttaggaggaaacacctgatgataaaacgacaaatatcttttctgtttgaagatcccggattctgtatagatgtattctgcaccattgcagaaccgatacgctactacaaccgggataccgaaagcggcgcatggtacagctctacaccggactggcatgaaaatggcagtctcatccgggaagaccttatctttgaagtgattgcaaatggtgtagtctgtgcactggatggcaatggtaactttgaaggcaagaaacccttcgtgcctttctaccaattccggcagtcgctggtgcagtccgttcatacacagcatccgcacctgcaggatcatgaagcactgagggaaaaactgctttccctgccggatgccagagaaacggttgggcatggttggtactgggaaaactggctctttgccaccgatgttgagaacaccgctgaggaagcagtagactcagccgaatggctaaatagtcagttccacattctggctatccgctatacccacaagcccaccggctttgcgtttaccaactaccgtttccgggacaaaagagccgaagccaaatcttccggacatgacctactgctctatgactggaaagaccaatgaccacactgcgtcaaaaaatgcagcaactatacacaaggaggatgcaaaatgaaaatccacgaagatcgttcccatatgaatattgataccagatggtttgaaaaaggctatgccaaagaagacgtccactccctgcgcctgcaatccctatgcaccgaagcagaggccgcagccaacaaacagttttatgacagccacacccgcgaagaatgggaacagtatatccgtcaggcaagtttggagagcagcgcagcaatgaaacccgtcatggaagccatcgcacagcactttgtctgctaccagtatgacgaaaatatccctgtgtcctatggcagcgaccgatgggatctgtacttctggtgtaatccctttaacagtgccgcagacgcatccgaacgggatttctcatatttcacgctgacctttaacgagcgtcagacgctggagaaacgaagaaaagtctgtcaacaggtgctggagctcctatgctcacgctttcaggagcatccccatctccatgtagccgtacagtattccatatggtttgaccatccgaagatccacgatgcggtggagcgcgcaaagccccgtctgcatggcctgcgctgtatccaggaccaaaaagaaggaaaactgctcctgcaggacggcgccctgctcttcaagccaaaatacgcaaagaaatatgcccgcacgctgagtcagagccagattttgtcccttagttgggaactgggcgtggcggacgaagaaccggatatcgatgcggcacctgttaccttgccttacaagaaatttggcgccacgcaccccatccagctgcaggtgacttcctacctgaatggaaaccttgccatacaaatggtgacatgggaaagcggcgacccggaaccctgggcgactctcaccgtcaacctgcccggccaacggcaaaaagaccatgcctttatcgacaccaatgccgattcggaatttcccacttggctcatacgacatggtctggctatcccaaccggccgcaccatgcagagtgggttctgcacctatcccgaatatcgttttcgtgccaaccggctgcaggagctggacccggaagggtatgcaggctacctgaaaaactttgaaaggcggtgcagcgcatgaaatataaggcagtttatgatgtactgaatgaaaggcggcagactacccccggtttctgttaccatgaccgcagcggctggcgtgcttacccccagacctacatgaccatgcagtgccctttatggattattgctgaagatgctgccacgggcaggcgtctgtggatcactcaggagggcccccgatttagcatttccattcgaaggatggatgaacagcggcacaactatggccctacctatcgcattacttgtgaaaacaggacaaaactggctcaggttctgcgctatcagttcgagtcaaaaactttggctgtgtagctgacgatgaccagagaggaactgcattcctctccctgctccggtttccttgtccggaacacacactaagaagcaccggcaatctgcatttttgcaggcgtccggtgcttctttggaggaaaacgcttatgaatactctcgtatttacactgggcgaacaccgatcccagctgactttgaaaatcagtacatatcccaacggcaatctcgccatcaagctttatgaaaaggatcacggcatcctgattttttgggaaacccttaccaccaacttaaccggaatccggcccgaccactgcgctttcatcaatataaaagccgcagacggactttttccagtctggctgtcagacaatcaccttgcggaacctaccgggcaaattcttgaatcggatggctgcctttaccctgaatacctgtttaatggcaaagaactggacgccctggaccatgaggggcataccctctacatccggcggcagaaaggcgaactggggcgccgctttgagcggctgtatcttgccctgcgaagactggcgcgagaaatcaacggattcagctacaccgattacagcggctggcggtgtctggatgggagttcctccaccctgcccctctggatcgaggcatttgacccttctcatggccgcaaattcatcttcacgcagaaaggtcccgcactccaaactaccatcctctatgcagatggtacagagaagcagcgcatctatcggcgtaaagaggacatggcaaccgagctgatggccatgtttcaggaagaattgcgtgtctaccctccctggtctgaagaccggaggaaacggtacgaatattaaagacaataaaataggaggacatcatcatgaagatccgtatctatcccaaatccctgttggaaaccgtatggcagcaggacaaactgctgtttaccccagaggcagagcaaccatccctgtgtcttcggtgtggtcagacgctggaccgcaggctggtcatcaacgccctgagccgctatgcagatgtccatatctgcgaggcgtgcggtatggatgaagccctgcgtgatgccaaccgttgcccactccctctaacagaatgggcagctgtcaaaaacggtttgagccagcagcagaccaattttgaagatccgctactgactacttcctgcgcctttgaagatctgtttcagcaaggctcccgtcctgccagcgagatagcctattcccgttctgattatgatggatggaaatggtggaccacctggcatcagtgccaaaaggatacgcctgttctggaagttgcccgtgaaattgatgctttccaggatgcgctattccaactgccggagtttcggaatttggacaccctgacacggttctgccgagggtacgcccagcccaccagcgagcccaccgaattcaatttgtattcggaaactgctcacttttatatctggctgtggctgattaccaggcgtcgagattataatgtgtatgtacattactatctgaaaggttaaaaagtctgcaacgcaccggatacagtatgcctatcgactctgtattcggtgcatttttctctatgaaatagttatttatttttatgtacacttataaaatcttgttgcaaaagtcaacctgctatataattataaagaaatatatttttcaaaatctgtccgttgtaatatttcgcagacatttgcctgttataatatccgcaaaagcaaaggaagttgagggatttttgagatttaccatatatcatataaagaatggaggtgcatgattttgaatcctaaattactgatcgttgatgatgaacgcggtattgttgatatgatacagagttattttcaaacacgatatgatattctgaccgcttatagcggccaagaagcactcaaaaaagtagcctacaaaccagatttaattttattagacatcaatatgcctggaatggatggcctgactgtatgccagaagatacgggaacacatagcctgtcccattctttttttgactgctcgtattgaatccagcgataagattattggatttcaggccggggcggatgattatatcgtcaagccctttgatttggatgaattgggggcgcgtattgctgcacatttgcgccgtgagcagcgacgccaaaataattcggcagtacgcttttttggtgaattgatgctggattattccgcccgaacggttacaatcaataatctgaacatcccactatctaagagggagtttgagattgtagaacttttatccctcaatgcaggacaggtttttgaccgcgagcgaatttatgagcttgtgtggggcttggatggggacggaaacagcgatacaattatggagcatattcggaaaatacgcgctaaatttgcagcacatacattgcacaattacattgaaacggtttgggggtgtggttatcggtggaacgcctaaaaaatatgggactaaagaaatctttcctgctattatccctctcctgtttggcagtggcatttctcctgcttggggcagttatcttcctatgccgaggcattgaaaaccattatcctttaggcggtgtagaaatcttgtcggatggctctgttgtacctttgccatctcctacggtgtcacaacagcgtattttggctaccctaaacattgtgcagacggtttcctgtattctttttccagtaggcggattgattgtttcagtctttcttttttattatctcaaattgaaacagcctatttcctgcctgcaaaacggcattatgcggattcagaataatgatctggatttttcgctgccgattttgtctaacgatgaaatgggacaactatgtgctgcctttgaagaaatgcggagtgaacttctgaaatcgaatcggctgttgtggcaacaggccgaggaacgcaaacggctcaatgccgcattttcccatgatctgcgtaacccgattacggtattaaaaggaagtgtaaaacttttacagcaaggtattcaggacgaacagaccatagaccggctggaaagttacactttacggattgagcagtatgtagaagctatgagcagtgttcaaaagttggaacaactctctgttaagccaaaagaaatcagactatccgttttgcagagtgaattgcaggaaacagcacgaatgttagcactatccaaaaaagtttctgttttagtaccatcaggtggaacagtttgtatagatcacgggctatttcttaccgtagcagaaaatctgattggaaatgcggcgcgatttgcagaaaaagcaatctctattcaaataacgctgcaaaatgattctatgaccttgaatgtagaagatgatggtgctggttatccgctgtctctcgtgcagaatgggccaaacccttttgaaacgacaagtagtaattcctcacatttcggaatggggctttacagcagcagaattttatgtgaaaaacatggtggccgattgattttggaaaatagggttgggggcggtgcatccgcaactgctatttttcatttcgtgtaatccttgagcgatttttgagatttatcatttacactctccttataccacaaataaggagagtgttttttatgaatattgaggcaaagaatttatcaaagatttatggtgacggtgaaaaccgagtggtggctttggatcatgcgaatctcgaaattgtatccagcgattttatttctattatgggaccatctggaagcggaaaaagcaccctgcttcatttgctttccggcttggataagccatcttccggttcgctgacctacgatggtaaagatatttacagttacagcgataaggagttgtcggcattccgccggaaacggatcggatttatttttcaacaatttaatctgcttccggttctgacggcgaaagaaaatattatcatgcctcttttgctggataaacaaaaaccggatgaagcatacctgaagcagcttacagaactgcttggcattcaggggcgcttggaacatctgccccatgagttatccggcggccagcagcagcgtgtagccattgcccgcgctttgattgcaaaaccagatgtgatttttgctgatgagcctacgggaaatctggacagcaaaagcggcggcgaagtcatggaactgcttcaaaatgtatggaaaaagatgggtaaagctctcgttgtcattacccatgacagccgtattgcgcgaatggcagaccgccagtttcagatcgtagatggtgtgcttgcggaggtgacaacgaaatgaaatcttatcgtacattagcattaaaagaactgctgtccccaaaagtcacttctattcttattttgattgccgttgtgctgtctactatgatgacaaccattgtaggacaatccattggcgtacttagtgcaatgcgggaacagcaagccatcgctatcggaggaaaccgatatgccacttttttgcagatgaatgcagatcagcttcacgcactggaacaggatgagcgcctttcctatgtagggaaatctatttatatgggaagtttagaactctccccatctcttacccttggtttgatggaatattgggatgatactgccgctatctatccatccagtaccagtgtagaagaaggtcgtctgccggaagccccgatggaaatagctctttcggaagatattctgaaatatcttggctttgagggcggtattggagataagattacactttcactgcaaaaaaatcttcgccacaacattgcggacagctattcctatacagcagaatttgttcttacagggatattgaaaaataactacttgggatatacaagcggcactgttacgggagttgtaggggaaggaactgctgaacaacttttaacggaatcttatatttattacaatgtggatattcggactgccgataaaaagaattttcaagcagttgtcgatgacatcaataaggaatttaatatccatgaacttgataccagctataatattgtatatttgaacgccttgggaatttcctatactgcaaattccgagggtgctaatgataagggattctcttttatgacagtcgcagggatattagtgggtactttgattttgctggctgctggtcttgtgatttacaacattctgaaaatatctgtatcaaaacggataaagggatatggaacacttcgggctattggaggcgaaaaaggacagctttatcagatcattgtaattgaagtaatcctattgtgcctgatggggattcctattggtatgcttcttggcttcctgagtgccagaggaattttagaggcagctaccggcttggtttcccctgaattgttcttggttcaggatgcttctgaattgaaaactctaatagcagagaacagttctttgaatggaaccttactggttttaagcggagcaatcactttggcgtttgcgttgtttgcagcattaccagcagccagatcagccgcaagggtatctcccattatggcgatgtctggaacaaatctaaaaattcggcgcagaaagcgtaaaacaaagaaaatccataattttgaagcatattatgcccgcctgaacttaaagagaaataaaggccgtactgcaattacaattttgtcccttgttatgagtatcacggtttttattgccctgcaagggttttcctctctcctgaacgctgcaagcgccctgcaagataatcatgtaggagattatcagatcacaaatgaaagtattggatttaccacagatgatctgaacactttgcggaaaaatgaagctgtgcaaagtgtagccgccatacaattttcgctttacgaacaaaatgaaaatgggctgctcgatgaaatcagtcttgaatttcaactgaaacccggcgaaacttttcaggttgtcggattgaacgatgaatattgggattattttatgggggatcaattaccagaagaacagcttggacaactgaaatcagggaacgcctgtatagtaaggaatcctattcccatgagctacggcgaagatgttcttgaatttacaaatatagaggccggagaaaacatctgtgttgcgggaatggagctgaatgttttgaaaaccttggatggctatgacggttatcttggtattggaaatggcggtttcacaaatggtgttcaagtgatcgttgatgatgctatctatgaacgcctgacgggaaaagatacctattcagagtttttgcctacactgaacgagggtgctgacagggaaaactttgatacatttatcgaggcgttttgtaacagaataccggggacaacattcttgtcatatgaagaaaccgaccagcaactaaaagagagctttgcacaaattcaaatgctggcatgggggctgattcttttcgttggcctgattggtattcttaatatcatcaataccgtttacacaaatattcacaccagagtaacagaaatcggtatgcagcgggccattggaatgagtgccgatagcctttataaaactttcctttgggaaggtgcatattacggaatcattgcctctgtgattggaagcgtgctgggatatgtttgtacgatcttcattgaggcggccacgagcgacaccatccagcttgttgcaatccctgtcatgcccattcttgaagcaaccctcttggcagtaggagcttgcttgctggcaacagcaattcctctgcggaaaatttcaaaaatgagtattgtagattccattgaaacggttgagtagaacactattttttgaactgtccgaactttctaatattttgtggacatttaggttttagaatgaccttatcagtgaaagcaggtggataaaggagcttttgtctatttgctgtgctgattctggtacagttggcggccactggcacaacagttttccgcatttaccccaagcaaaggaggcgaacaatatgggcaaatttttaatattatccgtcactgaccacgaagaacatatactcaataaaattatggaaactatcgcaaacgagccgaagcttaaccatattgcgcctcctctcccttgcaacattctttcttttaaaaatctggaaattcggctaaaggagcagacagtatcctgcagaggtcaacttgttactctgactcaccatgagtttgctgtccttacatatctggctcgtcatcccggctgggtattctcagccagccagatttatgaggccgtatgggatagagacggtgaacactgcggcaccgccgttgccagtgtcatcggtcaaatccggcgcaagttgacgccagatacaccaaagggtggctatatccgcaccgtaccgggcagtggatataaatttgaatccgtgatataggaaacgccggacatatgccgcttggctctgtccggcgcttcgttttatataaaacaagactacaagtattacttccttgcgttgattgagcgaagaaattataattgaggaatcatagaaatccacataatttatattctatgaaaaatggggtgttacctcaaggcagaccaattatttgtgtgccggtgggcgtatccccggtgctgtgaagatggctaccatttggctgattcccaaggatgcggagaaaccggcagaccgtcgtttcaaaaatacaaaaaaataatcctctcgtgaggtttctgtgacatttggatgctacactaagaatgaaggagtgtgatacaatgcgaattttagtagtcgaggatgaccgacttttgaataataccttgtgctataacctggatactgcgggctatgtcgtggactctgcattgacaaaatcagcagccagcaactttctgaccaagcaggactatgacctgatcgtgctggatgtaaacctgccggatgggaacggctttgatttctgccacgaggtaaaagagcgccgaccggatacggcggtgatcttcctgaccgcaaatgatatggagagcgatatgctgaggggctatgagctgggtgcagaggattatgtgaccaagccatttcctatgagcgtttttcaaaaaaaactgtccgtggtgctggggcggctggcgaagcagtctggcggcggggattgctacgaggatggtgtgctgtccatcaatttctcagagatgactgcttccctgtccggtaaggcactggtgtttactccgctggaataccggctgttgaaaatcctgaccaaaaatccgcagaatgttttgaccaggcaggtactgcttgaaaagctgtgggatgccgatgggaactttgtggatgaacatgccctgactgcggccatcagccgggtgcggaataaaattgaaacggatggacgccagtacatcaagacagtgtacggcatgggctatatgtggatcggagggacatcgaaatgaatatgcgaagactctccatcaacaaagcctgtatccttttgggaacgcttttgctgctggcagttggtgcagtctgcgctgctgtttatctgctgacccagaatataatcgctgtccggtgtgtgttcctgttcagtctctttgtgctgctctgtgttattttctttgtggccctgatccgccggaagctggtccggttctccgatgccttttgtggtcagatggatgatatgctctccggggatatgcagccgaagcagacggtcgaggaagaaagcctgttctataaaatcaactaccggctggggcggctgtacgaggtcatgcaggaaaataaaaacagcatcgcaaaagaacgggctgacctgcaggagctgatctctgacatctcccatcaggtcaagaccccgattgccaacttgaagatgatcaacaacacgctgcttgaaaacgaggttcccccgcagaagcaaaaggaatttttgacagcccaggccagccagcttgataagctggactttctcatgcaagctatgattaagacttcccgcctggaaacaggagtcatttcgctggagcaaaaacagcagccggtttatgatacccttgccgctgccctgggcgggattttgctcaatgccgaaaagaaacaaatagatgtgcaggtggaatgcccggagcatttggatgcacgccatgatagaaaatggacaagcgaagccctgttcaacattctggataacgcagtgaagtacaccccggcaggcgggcagatccgtgtgtcagtggaaggctgggaaatgtatgtgaagatcgacattgccgacaccggcatcggcatttcagagcagcaccaggggacgattttcaaacggttttaccgggaagatgcggtgcatgatgtggatggtattgggattgggctgtatctggcccgtgagatcgtgaccttgcagggcggctatatccgggtggcatctgaggttgggaaaggctcaaccttttctgttttcctgctccgaaagtagcgccgacacgccccaaaattgaaatgtcacagacttgtgacatttggggccgaatttagcggaaattttttgtggctcgtgacatttctgtgaggtttggtcgttacaatgggtttatcaaaaagaaaggatggtgttctttatgagcattttgcaaacgactgaactgaaaaaatattatggcgcagagccgaatattacaaaagcactggatggtgttaccctctctattgagcgtggtgagtttgttgcaattattggaacttctggaagtggaaaatccactttactgaatatgatgggcggtctggatgtgccaacttccggtcaggtaatcgtggatggcaaggaactttccaccctaaacgatgaggcactgactattttccgtagacgaaaaatcggctttatcttccagaactacaatctggtgccggtgctgaatgtctttgaaaatattgtgttgcctgtggaactggacggcgataaggttgacaagaagtttatggatgaagtagtgcggatgctggcactggaggataagctgaacaatatgcccaacaacctttccggcggtcagcaacagcgtgtggcgattgcccgcgctctggtgtcgaagcccgctatcgttctggccgatgaacccaccggcaatctggacagcaaaaccagcgccgatgtattgggacttttgaaggtaaccagccaaaaattccaccaaacccttgtgatgattacccacaataccgagattgcccagcttgccgaccgtattatccgcattgaggatggcaagatttccgagtaagggggcgaaagaaaatgaatgatattttatttggaaacacaaatcgccctgttatcaagaaattggccgggagatattttaagtccagtaaatccagaaatgtgatcgctgttattgcaattattttgacgagcattctattcacaaccattttcactctgggttctggtttgctggacaccattcaagatcaaaatatccgcaaggcgggcggtgatggtcatgctgctctctcctacatcagtgatgacatttttgacgaaataaaagataacgaactgattgaccgtatttcctatacaaaatctgtttcctatcgtctgcataatgcaggacttgaaaaatggcgagcagaaatgtggtatatggatgatacagcattggagtttggccgttatgaacccactacgggacgcacgccagaagcagaaaatgaaattatggtcgatacagaaacgctaaaagctttgggcgttcctgccgaattgggagcaacggtaccccttgaatatgaaataaaaggggaaacttacaccaccgactttgtactgtgtggattttgggaaacggacagtttaagcaatattgggcggctgattgtttccaaggcttttattgatgcgaactctgatctgttggcctatacctatcctgttgataatgattactctggcgtagtggtcgcttatatcatgttcaagggaaatggtgcgattgaaccgaaattaaaccaacttttgagcgaagctggttatacctgcgatacaatgggtggtattcgaggtgatgaaaattatataaatgctggtgttaatcctgcttatcaagggagcagtctgttggaaaatccgtttatgctgatttctggtattgtaggtgttctactcattatgatgacggggtatctgattatttataatatttttcagatttctgtaatccaagacattcaatcctatgggcaattaaaaacactgggaactacaagacggcaaatcaaaaaactaattagcaagcaggtcatgcggctatcttgtattggcatcccgattgggctgttaatcggctttttcattggccggtcattagtaccatttttgatgaatggaaccgcatatacggctgctgctggtataaaagttagcgtaaacccacttatttttattggctctgctatttttgcgtggattacagtctatatcagtgttcgtaaacctgcaaagattgctggaactgtttcccctgtcgaggcgatccgctatacggaaaatgacgcttctgcctttaagggcaaaaaagcaattacaaaaaaatcaacacacggcgcacagatttatcgaatggcactggcaaacctggggcgaaataaaaaacgcactatcttagtaattgtatcaatgaccttgagtttagtgctgttcaacactgtattcacactatccagcggatttgatattgataagtatgtaagtaaatttctgaacaaggattttatcatttcatcggcagactatttccagtatcgctttgatcgaagtgatgctgaattgtcacagacatttattcaggctgttcaacaggaagatgcctacgaggatggcggagagttgtctacggttcgagtattggaagaatttttctctgtggaaagtgaaacaatcgtaaaccataacaaggataaggcaggaaatccccatgtttctctttatggtgcagatgatttcctgttaaagtcaatggaagtaattgaggggaaaattgattgggaagctctgcgctctggaaaatatgtactttatggtctgcaaagtgatgataacgggaacattatccaagatcaatcggtacaagtcggtgatgtcctgcgtttccatcattcgacggcagatggactcaatagtacaatggatgctacggttgatttaacggtgatggcaaaagtccgaatcaataacagcgttgatacccaccggcaaacaggcggaacgaatttctatatgccaacagagaactttaagccactttgtaccgatccccatgtggtcaacttctcatttaatgtgaagccggggcaagagatggctatggaagattttttaacttcctatacagaaaatattgagccgggaatggattatgagtccaagcaaacctatgtcaactccttccatgatctaacttcgatgatcattacgattggcggcgccttgagtgtcattattggcttgattggtattactaattttatcaattccatgcttaccagtattatcacacgaaaaaaagaatttgctatgctacaaagcatcggtatgactggaaagcagttgaaatccatgctggcttgtgagggattatactatgcagtaggaacaattctggcttctgctttcttcggcacactgttttcgcttatcattgtacagggaattgcaaacagcatttggttcttcacatatcgctttgtaatttggccgatgttagtgatttacccgttcttattagctgtgacgattataattccatcaattttatataggaaaatagcgaaaacaagtatcatagaacgcttgcggacctctgcatagtgaaaacgaaaggggctgttgcaaaatacagccccttttcaaacttctaaaagttcgtgacactttgggtcaacttttctctaaaataatttctggcttgtaacttttctgtgcgttttggttgctgcaaaagaagggatgtaaacaagatgggcaaacttctgattctgtccgttcctgatcatgaagaacatataatcaacaaaattatggagcttattgcggacgagccagagtttatccaccttgctccatccctccctcagtctgcgctttccttccccggtcttgaaatccggctgaaggagcaaacggtatcctgcagcggtcaacttgttactttgactcaccatgagtttgctgtccttacatatctggctcgccatcctggctgggtgttttctgcctatcaaatctatgaagctatatggtgcaaagacggtgaaaactgcgggactgctgttgccagcgttatcggtcagatacggcgtaaattgacgccagaaacaccaaagggtggctatattcgcactgtactgggcagtggatataaatttgaatccgtaatataggaaacgccggacatatgctgattggctctgtccggcgcttcgttttgtataaaataaggcagcaaatatagcttttcgtattacttgaaaaaacgcatataaattcgacgaagggcagtctgctcttccccaatagactatttatagttttgaaccacaaggcggtgtaatatccaagccttcaaaaaagtgtattccccagttacacatagaatctaataccggaatgatactttttccaaaggcggtaagtgaatacaaggttttaggtggtttttctggaattacttctctgtgaatcatgccgcattcttccaaatcgcgaagttgttgtgaaagcattttaggtgtggcttttggaattaagcgttgtaattccatgtagtgcaaaggtttttctatcaaatgccaaagaatgagaggtttatattttcctccaatcagaaaaagtgtggcttccactggacaactaaattgatctttttgataattcatttttatatattcactcctttttgggtactttctttgagggaagtatctacctgaaaagtgcaatcttgttattctactgcaccatgttaaaattagtacgacgattgaacatgtcaattaaattatacagcaccaagaaaggattgaccatgatgaattttattgagattgcaaaaaacggtattctgtacgcaattacagtggcaaaaaagtggagaaagagaagcttgataaaattttgcaggctgctcatgttgcaccaacagcagcaaacctacagccggttcacttaattgcagtagaaagcaaagagggactggaaaaaatcagcaaaggggcaaatatttataatgctcctcttgcaattattgtatgtgcagatcataacaaagcatgggttcgcccctttgaccaaaagcaaaccggagacattgacgcagctatcctaacagaccatatgatgttggaggcaacagaattaggtttaggtaccgtatgggtatgttactttcagcctgatgttatccggaaagaatttgatttacccgataatttagagccaatcaatattttggtaatcggttatggaaatgaagcgccatcagatacagaaagacatgaacacatgaggattccactcactgacttagtttcgtatgaaaaactgtaaccgagtatgactcgatttccgaaatacttccgaactatcttcagctcattgcttctaaaaatagttgatgttataattgcggggaaacaactgaataaaagtgtcttcggggcagggtgaaattcccgattggcggtaaagtccgcgagcgtaaaacgcacgatttggtgtaattccaaaaccaacagtatagtctggatgaaagaagatatggttagatttccgcagattttaaggggcttactttcttttctgtggcctaattataatgttaacacccgaaagaccttttcttttgggtgttaattttttgccacggaggaaagcaattatgaacagtaaaacaaaaagagtcaccactattgggatgctatgtgcgatcacttatgtcaccatggttgtcggcaggattccgattattctattcttaaagtatgacccatccgatgttattgtaactttgggcggctttatttggggaccgatgacttcttgtatcgtatctgtcattgtggcaacccttgaaatgattacagtaagcgataccggaatattaggttgtatcatgaatatcgtacaaacactatcttttgcgtgtacggcgtctgtcatttacaaaaaaaagcacactttatctggtgcagtgattggtctggcatcgggatggctcataacggttgttgttatgctgttgtggaactatttggtaacgccgctttatatggggtatccaagagaagcagttgtagaattgttacttcctgcctttcttccatttaacttgttgaaaggtgggttaaatgcatccattacctttttactgtataagcccatagttaccgctttgagaaaaagcggatatgttgctgcttcggaaaatgaagcaagacaaaagcatactggtctgcttatattggcaagttttattattgtaacttgtgttttgattatcctgtcaatgaatgggattatatgaggatcgaaatgaaagaaaaactaaatgagcctatttacacactaacaggaaccgttatacatggccgaggtattggaaagcatgtggggacacctaccgcgaacatagcaatcgaaaaaaaagattttttgccaaagacaggagtatatgtggcagatattcttttaagcgataagagatattacggtgttacccacattgggacgcgccctacacttgataatgatagctttgtttcaatcgaaacatatatttttgattttgataaggatatatatgggtgtacgataactgtcaacctatataagaaattgagggaagtcagaaaattcaatgaattatccttgctgcttgaacaaattgcgaatgaccggacaatggcacaagaattttggggattaaagcaaacaaatcacaccttacacattgatgttaaccggcattgtgtaatattagaacagcaggaagtttatttatcaacaaacgaatttgaagtcctttatctgttactgcaatctcctcaaaccgcattcacaaaagaacagatttatgaacagatttggcatgaacccacaaataaccatttgcatgcagtggaaaacacgatttttcaaatacgaaaaaggctaaagccatattgcatgggacacgagtatataaaaacagtaattggctatggttataaattcaattccgagtaaggtggtaaacacaagagcaaatagcgccattctcaaaattttgaagtcttcgtgttcagcaaccttttataaacagaaacggctctgatactatcccccagttcatttaggtttcaccaaaaacaagaccactgcttattcatatagagagaagaaaggatgtgaacaatatgggcaaatttttaatattatccgttgcagaccatgaagaacacatactcaataaaattatggaagcccttgcagacgaaccagagcttgaccatattgctctcccactctcggatgacactctcccctttccggagcttgagattcgcctgaaggagcaggcagtattctgcagaggtcaacttgttacactaactcatcatgagtttgctgtccttgcttatctggctcgccatcctggctgggtcttttctgccagccaaatctatgaggctgtgtgggctgcggacggtgaacactgcggtaccgctgttgccagtgtaatcggtcagatccgtcgcaagttgacaccggatacgccgaagggcggttatatccggactgtactgggcagcggatataaatttaacagttctccattttaagtcagcaagaaaggctccgaggccataatgatctcggagcctttctcattgacttaaatcttaaacaacttaatcgccttcaacaaaataatgctcaattcctggtacaaatcctcatccagcacaccatcaataatggcatacttgagcagcaatggtcgatacatctgcaaaatcgtcgtaatggcatcctcgtttcccgccttggcgctgagaagcagacattcaaaattcatctcttgtcacctccttcaatgctctttctgattttctgaatcgtcctatagtaaagcgcagctgcccctttgtaggacagttcaaactttactcccagagtttcaaaatcttcttcctccagcgttcgagccagaaagatctggcgctcccgttcattgagtttctgaagtgcctccagaagcgctccattttcaatgacatccataagcggcaatttgtctaaaaccacttcctctgagcttggttcggactcatagaccacttccacagtactctctatactgctgcgcttataaagctggatcaaataatcttttctgcggcgcttgaccgccgaaactaaatatgctgtaaacctgaattgcaggtcatcttctgcctgtccattgttccgttgccacatggctttacctccaaaagtctcaagaatttctatgaatttcctgagcttctggcggtgacctgcaccggacaaaagctggctgtgataaacaaaaacagccagctttgtaccaatggacaaaaccagctgttccctgaattgctgcatcgagcagttcaatagataccatccgagcaggtggaggtttttctttatgtggagaaaactctctcgtcctgcctcgacgatatacccctattgagagccgttcatgaaaagccgtgtgtcctggagttatgaaagcaatgaactgctcgatgttgtggaatcctttttccataacatcgttactccctgtccgcagttatgcggacggcacacaggcggcctgcatcatcccctttctttcgcgatatggcagcgcaacgctgccgccctgctgataattgttaaattgtgaaataatacttttttcaaatgctattccaactattctatgaatctatgaaattaaaacaaaaggcggccttcatccttattgccaggataaagaccaccctcttcttccgattttcattgggtactgtactgatctcatccccccacctccacttatcgagttttcattggttttgggatcactgccataattacagtgtaactgacagttttcggaaacttttggagtagcattagagtcgctttcgagtaaaaagaaaatcattcgacattatatgacaaaacaggctctaaaacggacacactgcttttcaacctctctcagtgtcccgctttagagcccttcctttattttttagttatatcttcctctgttacctgggctgtatctggatggatataaatgatctggagtcctttcttcttggcatagttgaccgtctgctgggttccggaccgcatattgtgtgcattatcatagacagctatcatatgcccggcctgctccaccatatagtaattgcgtttcttatagctttcgcttgagggcatttcgcccaacactaagaccttctcagcatatctgcaaataaaatccatcctctttcggtgccagtcatcccagtctgaatcgtaaccctcaaaagggagcgccaagcacaattccacatcttgatatgtttgctgttctttcatgcgcagcagtatctccgctgcccacatatcaacgcccattgctcctccaacccaaaagcatcgtactccctgatgatagagtcgtatgagttgctcctgcagacactttttaatccgttggcagcgtttatccttttcattatatttgaacttaaatctggtcggtctgtgacctgtaatcacacacgaaaaactgttcatataattctcctttcctggcgtactcctctgcatattatacttgccatggacgagataaatcaaccatgaccgcttaataatccatgtcatagcggataaaatgtaactatagcatggaggtgacgcatggaaaatctactgaaagatatgggtaaacggatcttcgaccggaggaaacaactaaatatgacccaagaaactctggcagagctggctcatgtcacaccacagaccatctccaccgcagaactgggtcaaaaggctatgcggcctgagacgatcctcaaagtctgtgatgcacttcacatcagcaccgagtatttgttgcgaggcgtcatcacagaaacagattcctcccttcttatggagaagatttccacactaacacccaaacaatacaggcattttgaagatattttagacagttttatcgcggccatacaggaagaggcataggagcatcgctggctcccatgcctcttttgattatccccggctgcggaatgcagacaaggcaccagcaatcagtctgcgtgtcctatcgtccatttccgaatcatcgtccacttcctgtgcagttgaaggcatcacaggcgctacggacccctcaaccaatctggctgtgatcgcctgctcttttgctttttcctgtcccataccttcctgccgcaaaatctctttgacgatagccactaccgcttctttgctgataatcgaagcatttagtggctgcggctcctgcctaaagtgctcattatagtagaccactgcatttgccacatattgcgctttcgtgcggggactctgcagctccagcaatcctatggcagcttcgtgtatgggatcgccctcattaaagcgcagcgtaaacctccctcgttcttttttctcgcccataccatcacctgcctgctgtttcaatccggtacagatactcatagccatccgcatttgcattgattttcggtacgaagaatggtgttcccaccttgcccgaagtttcgatctgccgcttcaaaagaatggcgccaccgcctacaaatactaccttgcaatattgcaagtccaacattcgctcccgcaacgtgctgaacaggtcattgataaattcctgcgccatctgttctgtcagccgtatggctgcatccggatattgagtcttttttcccatcaggatagcgtccacatctccttcatccaacagcaggtccagctccgaattcacctttgaacgcaccttattgtacaacagaattacaccattttctaacgaatcacaggaggtaaggtcaatctctccatttttcatcagcagatagtcagccgtaaacccgccaatatccagaatcaccgctttgggttcctccacgagcgtgtgaagcatggtggctgctgctgcgtaagcctgggggaagcaggccgcatcttcaatatagatggaatacggcttcccctgcatctcaaactctatcactcctcgctgtctgaagtattgtgtgaaccgttccacctgggcgccaaagtgtgccggcggcagtccaactgccagttggatacgctgaacctccgaggaatatgcccccctcgcttcaatctctccagccagagcaaatagggtcaggataaagaagcgatcatcctccgttttatctttccgataaggaatccgctcagtagacagcgtatagtaggtattctgatacctcagcacattctgtccaaagggacgggtgacactctgcttcagaccggacacaaaggggttgcaatgaaccgttttaatttgtttgttgccatgatcaacgccaataagcatatgtaatgcctcctttttgctttatacatatcctttacgcctatatgacgcctattctcaacaatcacacactattttctaaaaacaaaaagcaggagacccatcataaaggtttcccgcttttggctgcttcataatgtgcgcagctaatatatatttgattgttctattctgccataccctgcggaacttcaaatttgtatccgctccccaaaacagtacggatataacccgctttcggcatatccggtgtcagttttctgcggatctgaccaatgacgctggcaacggctgttccgcagttttcaccatcctcaccccatacttcttcataaatctgcccggcagaaaatacccaggacgggtggtttgccaagtataccaatgtcgcaaattcccgatgggtcatagaaattaactcgccgtttcggtgtaccgttctctccttcaagcgaagctccaatcccggaaaaacaagagtattacaaggatgagatgacacaatatggtcaaatcctggctcggctgcaataatctccataattctgctaagtatgtattcttcatggtctgttaccgacaatacaaagatttttcccatatgtccctcccttattcataattagaatgctgataccctgcagccaatataaagtttacttgtttatttcagtaataacgactgttccgtttttatccagcaaaggggtaatccccgtatcatggacaaggtagtttacacctgtttcggtgtctacaacaatactcaaggaagttccctgtgtatagattgtttcaaagcgcttttctttgtttgccatagtaatccactcctttgcatagtgtaaggtatcagcatttctaatttattactctatgataaaggccaaatgttgcagaaatctcctaaccgctttctttttcggcaagaaaacaggcggaattgcttcatttttgtagcaattcaattttcatctcatttcaggccgaagaataacccgtttgaataagaacattgttgcaccaaaataggtcaggtagattgcacagaatagcagaatcgtcaccagaccataaagaggtacaagtccctgctgcaagattgcctctccgaaaaagaactgtgcccctgcgatcagcaaaactgtcagcaaaagcgggaatagcagtgggatcaaaaagactgtggacagttccctgcggattagggaagcctgcctatgactcggtacacccaaacggtcaatgaccgcataattcttttggtttttgtctatggcagaaagctgctcaaatgcaagaaccgagcaggataggatgataaaaataatgcttaaatacaatccgcagaatgaaatcgctgtaaatccagtcagcgaattggcaatgccccacgcctttactgtaacacccatcgttactttttccgggagctgctgaccggactgcaattccggctgccatttcccactgttcaggaattgcttcaagtcgctttttaattccgggtatccgccatctttcagtttcagtgccagacggattttttctccaactaattgtgaagctgcttcatccggcagaacaagcacatatcccttcgttccggccatttgatactgctccatcggctccgtcaggatcggtgtttccgcaacggtcaaggtccaaccattgaatgtgagctccggctgctgcttcaagccctgcccgattccgtccatatagttccatgtatcacaatgaaccaaaaattcgtttttgcccatgacaacaggagaaagccccaggatttcacgcagatggttatagtcggacaaggacaaggcttcaatcggtttttcaggaactgcatacagataatagatcacagaatcctcgacttcacaatgctcctctgtaaaggaaacgatggaatccatgctggatttctccaaaggtgcatcaatcgccacgcctgcatcatagggatagtaggctttcatgttggctttgtagcctgcccccatggtaagccccacaaacatggttgccagggatatggttaaaagaatcgccaccacagccattgtccggccagcagaatggatgcgccgcccaatctgccccaagaagaacagattttcttctttgtacttatggcacaaattttgttttgcaaatcggtgcagcaaaagaggtatctggcgatgcagctcgtaaacacccaccagaatgagtaggcaggctccgccaaggtacaaaaatgcttcattggtttgtgtttgaagcatccgcccaagcaaaatcacgcctgcaaccattgcggctattgaaagcaatactaccaaaagactatggcggaatgatttgaaatggtattcttcattcttgcggttatcatacagcagatcgattactttctgatgccggataatctttgctgctcggagcatcccaaaaccatacatcaaggcaaaaaacaaaaatgttactgcccatgcctggagagaaaaggaaacctgataggtatgcggcacctcaaagatattttttaccacctgattcagcaaaccggaaagtcctgtaccaaccaaagaaccaagcagaaaagctcctgtgccgatgatgctgttttcagcaaggaacaaatttcgtactgtctttgcttccatgccaatcagttcgtaggttgcaaattcctttttccgtcgtcctagcataaaacggatcgcataaccgatcacaaacgaggacataaaagcaaccagagctgacataagcagaattccagtagtcagcatcgacatattttctgccatagcaagaacatctgatgagaagcccaatgccaaaaatgagtacatcaatgccgcagtcaaggtaagcgtcacaaagtaaatgatataatcccgcaggcttctgcggatattacggagtgccaatttagcgtacatcactcacgccccctcccatcatggtgaggacatccagaattttttcaaagaaagttctgcgtgaatcgctgcctttgaaaatttctgtaaagattgccccatccctcaaaaagagaatacgattggcatagcttgccgagaaagcgtcgtgtgtcaccatcaggatcgtggctccgagatcttcgttgatactctggatcgtcgaaagcagcatctgggacgagtgactatctaacgcgccggtgggttcatccgccaaaatcagcttaggctggttaataatggctctggcacaggcgcaccgctgcttctggccgccggacacctgataggggtacttatccagaatatccgtgatattcagctttccggccatttcccgaacccgtccatcaacctcccctgcgggaaccttgttgatggtcagcgccagggcgatgttttccgaaatggtcagcgtgtccagcaggttaaaatcctggaacacaaatccaagattttcccggcgaaaccgggcaatctgtttttcattgatttccgtcacatcggttccatccagatagatatgtcccgcactgaccatatcaatggtggaaatacagttgagcagggtggtcttgccggagccggatgctcccatgattcctacaaattctccctcttgaacggaaaagctgatgtcctgaattgcttttgtaacattcccgctatttccgtaatatttttggatatgatccagtttcaaaatttctttcattgttatcacctctgatctctattgtaaaataagagcggcttcgtttgtatcaagttttcttacaaagttctaacaaaaatgtaagaagtgcagaacggttctcagctctgcacttcatgaatcaaacagttaatatgaaaagaaagggaaattgctgtgccatgttccgacgactccgccgtaatgccaatgcccagcttttcacaaagccgtttgcatagatacagaccaattcctgtggattgctgaatcagacgaccattctgaccggtaaatcccttttcaaaaatacggggcagatcggacgcagcaatcccgattccattgtcctccacgacaagaacaacctgatcctgtcgtttatgagtagaaatgcggagaaccggctgttccgtacgatacttgaccgcattggcaatcagttggttcagaataaagcgcacccacttttcatctgaataaaccgtgtcctgcatttcctccacttccagacacataccactttggagcagcagatatttattatctgcaatcgcctgatgcaccacttgggacagtgccatttcccggacagaataatctttctctgtatgctcactgcgggcataataaagagcctgttcggtaaagcggttggtcttttccagttccagcagaagttcctttgtccagtccatccgatggttttcacatagaagtttcatggcagtaatgggcgttttgatttcgtgaatccattgttcaatgtattccttgtactccaggcgttcccgctcgacctccccgatctgctccaacatggattttccagccattttcaaaagctgatagtaaacctgatcctcagcctgttccggcagctccatcacttcggaaataaggtatctctcagagagctgctctgccatatccagaagttttttcatctgccgctttcgtttccagtaagtgaggacaagtcccatcagcaaaatcaatgcccatacaatcaggatcaatactactgcggaaaccgaattgccgcacaccagcaaaaatacagtgagtgcagccatacaaacaaggttcgtcagcagaaatggcagcctgtttttccaatatcgtctgctgttcatatcgtgtacccctgtcggtgctttgtcttgataaaatccgtcagaccgatgcccgccagtttttcccggatgcggttgatattgacgctcaaagcattgtcatccacatatagctgattgtcccacaaatactcaatcatatctccgcgagaacagattttcccaccgttcttgaacaggtaatagagaattttcaattcgttcttagtaagttctacgctccgtccattatagtccaaactgctggattccagatgcagcaccgcatctccatagacgatctgctcccgttgctgtgcgggataggctttcttcagcagagaagcaattttcgcaagcaggattgctgtgttatagggcttcgtgataaa
